United States Patent 7,745,391 (HUMAN THROMBOSPONDIN POLYPEPTIDE) - sequence listing, part 170

SEQ ID NO: 429602 - DNA, 1281 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgccactaaaaataaacatacgccaaaaatcatttaacatatctatatattttgggggtaaattttacccttttttccacaacagtttttttagtactattccgagaaagccctctactttactaagaactaaccccctatctt

SEQ ID NO: 429603 - DNA, 1123 bp, Homo sapiens
cagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429604 - DNA, 1374 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacacagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcgcttctggtctgtgtgtctgtggctggggtgaagtaaggggaccccgggcctgaaaccctctcccaccttctcctgccatctccagttactgccctgctcctcccaccctggcccagggaaggactgggtgtcctccggccatatggtccctgaagcctctagggaccagagtccctagtaagtgggctctgtgctcagctgagaccagcaggggacaggggacggagggaatgggcctcatggccttctcagggcttgtgggaaagggaggaccatgggaatc

SEQ ID NO: 429605 - DNA, 1847 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcaaaaaaaaaaaaaaaaaaaaaaaaaaaaaaaaaaaaaaaaaaaaaaaaacaacacacacacaaaaaaacaaaaaaaaacaaaaaaaaaaaaaaaaaaaaaaacaacacaaccaacaaaaaaaaacagaacaaaaacagagagagggggggggcgacggacgacgagacaaaggcacagggacggacaggcggcagggaccagggagatgacaagaagagagggaggagagccacggggaagaaaaagagagcaaggaggcagggcggcacacagcgcgagggaggaggcgggaaaggcaggggagagcggcgaagcagggacgagagacagcacgagaggcggagcgagaacacgaacacagagagcccacaccgcaagacaaccaggaccagaaaccaccgcagcccggaaggacccaacaccacaccgccgccggagcgcaagcaacggaaaccaacaccagaaagagccggcggagagccaaacgcggagccgagacgacaacgaagaacataaccacgacggccgagcagcgcaccacagcgccgcagccgggggcaaggcggccgcgcccccgacgccgcgacgaggcgcagcgcccgcgcgggcgcgggcggggacgcggccgggcgggggacgagggcgcaccgggaccgggaagaaagggcggacgggagagggggcgagagaggcgcggggcgggcgacagcacgccaagcgcacggcggaccggcggggcgcggcagagacacgaccggaccgaggcaagaacggagacgacatcgacac

SEQ ID NO: 429606 - DNA, 968 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacacccccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctcgaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429607 - DNA, 1064 bp, Homo sapiens
cagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctcaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429608 - DNA, 1372 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggcaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcaaaaaaaaaaaaaaaaaaaaaaaaaaaaaaaaaaaaaaaaaaaaaaaaacaacacacacacaaaaaaacaaaaaaaaacaaaaaaaaaaaaaaaaaaaaaaacaacacaaccaacaaaaaaaaacagaacaaaaacagagagagggggggggcgacggacgacgagacaaaggcacagggacggacaggcggcagggaccagggagatgacaagaagagagggaggagagccacggggaagaaaaagagagcaaggaggcagggcggcacacagcgcgagggaggaggcgggaaaggcaggggagagcggcgaagcagggacgagagacagcacgagaggcggagcgagaacacgaacacagagagcccacaccgcaagacaaccaggaccagaaaccaccgcagcccggaaggacccaacaccacaccgccgccggagcgcaagcaacggaaaccaacaccagaaagagccggcggagagccaaacgcggagccgagacgacaacgaagaacataaccacgacggccgagcagcgcaccacagcgccgcagccgggggcaaggcggccgcgcccccgacgccgcgacgaggcgcagcgcccgcgcgggcgcgggcggggacgcggccgggcgggggacgagggcgcaccgggaccgggaagaaagggcggacgggagagggggcgagagaggcgcggggcgggcgacagcacgccaagcgcacggcggaccggcggggcgcggcagagacacgaccggaccgaggcaagaacggagacgacatcgacac

SEQ ID NO: 429609 - DNA, 950 bp, Homo sapiens
  misc_feature (97)..(97): n is a, c, g, or t
  misc_feature (161)..(161): n is a, c, g, or t
aaccccccctccccggaggcttttatagacgaaaagaattcccccccccctctcaaaggaggccaagcccctattcctgcaaagcggcggggtcacnaagtgtaggtatccttttcatgagatctgtgaggaggctggggccggtccaaaaaaagggtggncagcagaatctgttttccaatttgagaggaggtgttttaagcaaacgaagacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggatcggcc

SEQ ID NO: 429610 - DNA, 4250 bp, Homo sapiens
  misc_feature (3415)..(3415): n is a, c, g, or t
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagntttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctcca

SEQ ID NO: 429611 - DNA, 4185 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgatttgtaagtgctggcagatgccacttggggacctgccaagtgaattccttgtcctcacctcatgtttcccaagcccagcaggaaacatacttgggcttttggattaattctaaaaaaagccaatgcaacattttccttagtggaacctattgaatgcaaacttcaaattcaaccaaaatcggggaaattaatgcatgtgctttacttttcttctaatgaagtcacatgatgcttctttgtgttgacatttattggtgcacaaaaatacttactgaatgtgtgctctgtgtaaaacaccaggagcaaacaaagataccatcaaggcatttgcaatcttgttagtagaagcaacattaaaagtattcaggagtagatcaaaggggactcggcataattgaatgtctgtctattcttttataggtttttcatggattgactaccttctgtctcagaaagttactgatgtttgtgtcagttcatcattaagctaaactctgactttcataataaaagggataaacaaagcctaaatgctagttgtgggaatactaaagcagttttttaaaaaggaaatagtagtttcatgccctcacataccattaaaagatgaacaaacatggacaaatattcaaaactgcagtcattgaaaaatataattcacaataatttagacttcatattattgtatcataaaatattcagtggaccctgaaatgaagtcagttttattcatttagaattatatctattgtgtctgtgaaatgataaatcctaaatagagaaatttgaatggatggggtttttctgactaaaatgaaattttttttctgaataattcagtttagtgagtgcttatgatatacttgtctgcagtgatagagtcactatagattatttggttattttggaaaaaccaagggttttcttaaatcagggatgtccaatctttttgcatccctgggccatacttgaagaagaagaattgtctttggcctcacataaactacactaacaatagctgatgagctactaaa

SEQ ID NO: 429612 - DNA, 847 bp, Homo sapiens
  misc_feature (25)..(25): n is a, c, g, or t
  misc_feature (27)..(27): n is a, c, g, or t
ctcacaagatatttaatgaagggcngngtgcccggggcaaaaaaaatgggtgtacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggatcggcc

SEQ ID NO: 429613 - DNA, 1503 bp, Homo sapiens
cagtctatgaaactgtacactgtggtcttgggctgttattttatctcctttagaagaaacaaagagcagcagcacagtaaaggaagagaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgatttgtaagtgctggcagatgccacttggggacctgccaagtgaattccttgtcctcacctcatgtttcccaagcccagcaggaaacatacttgggcttttggattaattctaaaaaaagccaatgcaacattttccttagtggaacctattgaatgcaaacttcaaattcaaccaaaatcggggaaattaatgcatgtgctttacttttcttctaatgaagtcacatgatgcttctttgtgttgacatttattggtgcacaaaaatacttactgaatgtgtgctctgtgtaaaacaccaggagcaaacaaagataccatcaaggcatttgcaatcttgttagtagaagcaacattaaaagtattcaggagtagatcaaaggggactcggcataattgaatgtctgtctattcttttataggtttttcatggattgactaccttctgtctcagaaagttactgatgtttgtgtcagttcatcattaagctaaactctgactttcataataaaagggataaacaaagcctaaatgctagttgtgggaatactaaagcagttttttaaaaaggaaatagtagtttcatgccctcacataccattaaaagatgaacaaacatggacaaatattcaaaactgcagtcattgaaaaatataattcacaataatttagacttcatattattgtatcataaaatattcagtggaccctgaaatgaagtcagttttattcatttagaattatatctattgtgtctgtgaaatgataaatcctaaatagagaaatttgaatggatggggtttttctgactaaaatgaaattttttttctgaataattcagtttagtgagtgcttatgatatacttgtctgcagtgatagagtcactatagattatttggttattttggaaaaaccaagggttttcttaaatcagggatgtccaatctttttgcatccctgggccatacttgaagaagaagaattgtctttggcctcacataaactacactaacaatagctgatgagctactaaa

SEQ ID NO: 429614 - DNA, 157 bp, Homo sapiens
tgaatttttccattaatgcacacattcccaaggtatattttctcctagctttcttttatttttctacccttattttcctttagcctaaatttatttattcttacaaattcttttcctgttatattgtaagtttgcatataaccttcctcaatttctg

SEQ ID NO: 429615 - DNA, 1112 bp, Homo sapiens
tgcaacgactctcttaatcttccaccgctacagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggatcggcc

SEQ ID NO: 429616 - DNA, 3207 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggatcggcc

SEQ ID NO: 429617 - DNA, 1117 bp, Homo sapiens
  misc_feature (21)..(21): n is a, c, g, or t
gtcatcatgagacactctctnaattctcaccgctacagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggatcggcc

SEQ ID NO: 429618 - DNA, 1119 bp, Homo sapiens
  misc_feature (2)..(2): n is a, c, g, or t
  misc_feature (24)..(24): n is a, c, g, or t
  misc_feature (29)..(29): n is a, c, g, or t
cnctaagcgtgactgactctcttncttanccaccgctcagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggatcggcc

SEQ ID NO: 429619 - DNA, 2254 bp, Homo sapiens
  misc_feature (1419)..(1419): n is a, c, g, or t
tgcaacgactctcttaatcttccaccgctacagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagntttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctcca

SEQ ID NO: 429620 - DNA, 1168 bp, Homo sapiens
  misc_feature (1108)..(1108): n is a, c, g, or t
  misc_feature (1112)..(1112): n is a, c, g, or t
tgcaacgactctcttaatcttccaccgctacagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggtangcgngccagaggttcacacttcccaagttcatgcacaccagactgtcctacagcagaata

SEQ ID NO: 429621 - DNA, 2189 bp, Homo sapiens
tgcaacgactctcttaatcttccaccgctacagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgatttgtaagtgctggcagatgccacttggggacctgccaagtgaattccttgtcctcacctcatgtttcccaagcccagcaggaaacatacttgggcttttggattaattctaaaaaaagccaatgcaacattttccttagtggaacctattgaatgcaaacttcaaattcaaccaaaatcggggaaattaatgcatgtgctttacttttcttctaatgaagtcacatgatgcttctttgtgttgacatttattggtgcacaaaaatacttactgaatgtgtgctctgtgtaaaacaccaggagcaaacaaagataccatcaaggcatttgcaatcttgttagtagaagcaacattaaaagtattcaggagtagatcaaaggggactcggcataattgaatgtctgtctattcttttataggtttttcatggattgactaccttctgtctcagaaagttactgatgtttgtgtcagttcatcattaagctaaactctgactttcataataaaagggataaacaaagcctaaatgctagttgtgggaatactaaagcagttttttaaaaaggaaatagtagtttcatgccctcacataccattaaaagatgaacaaacatggacaaatattcaaaactgcagtcattgaaaaatataattcacaataatttagacttcatattattgtatcataaaatattcagtggaccctgaaatgaagtcagttttattcatttagaattatatctattgtgtctgtgaaatgataaatcctaaatagagaaatttgaatggatggggtttttctgactaaaatgaaattttttttctgaataattcagtttagtgagtgcttatgatatacttgtctgcagtgatagagtcactatagattatttggttattttggaaaaaccaagggttttcttaaatcagggatgtccaatctttttgcatccctgggccatacttgaagaagaagaattgtctttggcctcacataaactacactaacaatagctgatgagctactaaa

SEQ ID NO: 429622 - DNA, 3168 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcatatttatagtgaagaaaatatagaatattctccacccaatgccttccttgaagaggatggaacaagtctccttatttcctgtgcaaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggatcggcc

SEQ ID NO: 429623 - DNA, 4271 bp, Homo sapiens
  misc_feature (3436)..(3436): n is a, c, g, or t
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcatatttatagtgaagaaaatatagaatattctccacccaatgccttccttgaagaggatggaacaagtctccttatttcctgtgcaaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaaccagaaaggacacaaatagatgtaggcagaatacctttacagaggttaaaattgaaatgcatcttctgcagacaccgggttaagagggtctctggaggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagntttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctcca

SEQ ID NO: 429624 - DNA, 2748 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagtaaatggatctataattcatcaatcactggcttttcagcatttcacatcatctttatttctcacttttttggaacctgtcagatctgttgcatggactattggcattcttaatggttatatcattctttttcatatttctgctggtaaaagtatgagttggtatattcatccttttttcaccactttcatgtagtatccgtggagagcaggtctggttttttttgttggtttgtttgtttggggtccagttgaggagtcatgatggggttcctttcacatgtttggattttacttactttaagatctagtttataaaaacttaatttgaaagtctgatactgattgatgactgcttttctttgtgacttttaaaagagaaatgaatgttcctttggttgttctga

SEQ ID NO: 429625 - DNA, 2115 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtgtatgtggcaatatccattttttaccatattcattatatggtgagagcacattttgaaaacaacatgctgtgcactgaaatcctcctttagggcacagataaataacattttacatttatgggtcttaatcatattcattcaataactgggaggtaagcctcctgtgagctgtggctcacatagtgataatttagcacatggagcttatggccacgtgtcgatgcttgattttcttttttttgttaaaaaattaaactctttactttgaggtaattgt

SEQ ID NO: 429626 - DNA, 1002 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtacattcatatttacagtgagttttgtaaagatcattggatgtgacagttttgttaccatttaagcagtttagaagtgttcttttgttgtgcttttgggtgatccataattcctcaaaggacaacaggaaatattcatcagtaggatttctgctgctggtatttttcaaactgaagctagataatcgtacaaatacctgaaattgttcagtagtaacatggtatgtggttatctggctgatcttttcattacattaaaactttttaaagcaaaaatacattataaaaatgtttggaaaacaggaaatatgatgcatcatactgacaccttaaagcagaagcagtattttagatatatttttccagtactttccctcaatcattaaaaaaatgttatatttgaaca

SEQ ID NO: 429627 - DNA, 391 bp, Homo sapiens
gcctcccacccaccccctcgacgggagggtgaggcgcggcgcagtgatcgggcggccggggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccaggtaaccgcttttccggagtctgggggccagggcggggggagggtccggagaggtcttcccggcactgcccccctccgcgtggggcacgggggtgcgggcgtccgggcgagcggcgacgctggggcagagacgctccgtccgtgactgcagcgactgtcaagctggggagggagcggccggccgcggccgc

SEQ ID NO: 429628 - DNA, 321 bp, Homo sapiens
tggcatcaccaagttgaagtatgtaagtttagggaacttttgtttatgtttaatgtctcctttcctgtaggtgggcccatgtcatgtgcgccgttgcggtcccagaagttcgattcactaatgtcccagaaaggacacaaatagatgtaggcagaatacctttacagaggttaaaattggtgagtggcaaagcttcttttttacctcataaattagtgttaatttcaagttctgaatttttccattaatgcacacattcccaaggtatattttctcctagctttcttttatttttctacccttattttcctttagcctaaa

SEQ ID NO: 429629 - DNA, 1155 bp, Homo sapiens
ttggtgattgtgaggggttgcagacgggagagagggcgtttagctgcacgactctcttaatcctccacggctacagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggatcggcc

SEQ ID NO: 429630 - DNA, 2654 bp, Homo sapiens
ccccacacgacctgtatcacccacctgagcatatataatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaataaatacggatcggcc

SEQ ID NO: 429631 - DNA, 2430 bp, Homo sapiens
  misc_feature (1419)..(1419): n is a, c, g, or t
tgcaacgactctcttaatcttccaccgctacagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagntttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctccaaaaaaaaagaaaaaaaagaaaaaaaaaatttgtgggcgcgccgcgccaaaagttcaagaactcgggggggggccccgtggtatcacattgcctcgctggccaagaaccggcgcaggtgggtcccaaaaaagcgggccgggctcacccagggtggccggaaaagcagaaccccgccg

SEQ ID NO: 429632 - DNA, 1117 bp, Homo sapiens
  misc_feature (1079)..(1079): n is a, c, g, or t
  misc_feature (1089)..(1089): n is a, c, g, or t
  misc_feature (1092)..(1093): n is a, c, g, or t
  misc_feature (1097)..(1097): n is a, c, g, or t
tgcaacgactctcttaatcttccaccgctacagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagntggtccccanagnnctanccctcagataaacgagagac

SEQ ID NO: 429633 - DNA, 823 bp, Homo sapiens
tgcaacgactctcttaatcttccaccgctacagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataggtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgggtaagatgtgccctcccttcctcagtgctaagaccgtgtctggattttctcctgttttagactacctcccagacataatgtgctttattctgtaatatgactcattgttgacatgtctagaccgtgagttccttgagggcagggatt

SEQ ID NO: 429634 - DNA, 1481 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattggtaagctatgcctcaaaaataaagcaaaaattaaatgtgtattctggttattttagtaggaaccctacgatcctgtgcagcatttatttattcttcctcactggcgccatgtgcctctcaccacagcaattcacttcaggctcgatacatttattttacatagccaatattaccaattttagctgaatttgtctgttttgagattaatgtggagcaatttaccctgataggtaatttgatgcgacgtgtgtttgctttttatcttgaggcctccagttggtgttttgcaagattttccagtggcatcatgtggctccatgttaggtagactcagatctctccctgtttgcgatcagtttgtggcttagaaaacagcactttacagaagggagtgtctgat

SEQ ID NO: 429635 - DNA, 1427 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattggtaagctatgcctcaaaaataaagcacatttatttattcttcctcactggcgccatgtgcctctcaccacagcaattcacttcaggctcgatacatttattttacatagccaatattaccaattttagctgaatttgtctgttttgagattaatgtggagcaatttaccctgataggtaatttgatgcgacgtgtgtttgctttttatcttgaggcctccagttggtgttttgcaagattttccagtggcatcatgtggctccatgttaggtagactcagatctctccctgtttgcgatcagtttgtggcttagaaaacagcactttacagaagggagtgtctgat

SEQ ID NO: 429636 - DNA, 729 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgaggtttcttcctgtgcgttgtaacctggcaaatgttcaggcttctgagaagaaggttgagctgatgggtcatccagatcctggcctgaaagttgcatgtctgagtgcttgaaaataaaataaaactcaatcttaag

SEQ ID NO: 429637 - DNA, 853 bp, Homo sapiens
aaaaggatgactttggagctgtaggattgaatgactggcctactgggttttggacgttcatgtatcctagcaggacaaacaggcccggtggtgtcaggagcccaggtctccagctggagggaacgtcaaccctgcagtgggagcaggggcccatcgcacatcctaggcacagatgctaatgcaggcactgcagaccataaaggagaacagcaagaagcccccagcaaacatccacagatggccctggacatcagccacattctgaggaacatgtcatgttctgggagggctaaggcatcaaccttaccctgtaggaattctagtgactatgttgccaccatcttggagctccatgccctcatagtgtaatggcaccagcagatctgcctgtgcacagacttcctgtactacctcactcctgaggggagatgcttctgcgggcctgcgacctggtgctcaactttagacaccatcatcctggagcggcactgcaccctcactagccagggtgttgacgtcctcaaggccaaggccacattcaagactttggacttcattgatgcacttgtgccgagcaagatcctggttggagtaaaacattccatgggaactcgggctgtgagaaatgtcctaaccacctgactgcagaaacatccttatcacatcctgctgggcaaaggcccaacagcctgacttcaggaacatccttatcatcttctactgagcagcaagctatactgtccagagccctccctcccagcgctatgattaccccagcctgtgagcggcagtgggcactgacactaagctggtttccccctccgcagggttttgctagtaataaacctgtgtt

SEQ ID NO: 429638 - DNA, 461 bp, Homo sapiens
gtaagctgggcttggtatccttccctggcttcagaaagaagccaacaaggagcgttttgcagaatgaaacctttgtttccagaagcactgctgactgtaagtggttgccgtttgtggcagtgagcattttgtccattctgaggttggattggtttctccttttggccttgccctgccctacagaccataaaggagaacagcaagaagcccccagcaaacatccacagatggccctggacatcagccacattctgagaaacatccttatcacatcctgctgggcaaaggcccaacagcctgacttcaggaacatccttatcatcttctactgagcagcaagctatactgtccagagccctccctcccagcgctatgattaccccagcctgtgagcggcagtgggcactgacactaagctggtttccccctccgcagggttttgctagtaataaacctgtgtt

SEQ ID NO: 429639 - DNA, 1308 bp, Homo sapiens
gtaagctgggcttggtatccttccctggcttcagaaagaagccaacaaggagcgttttgcagaatgaaacctttgtttccagaagcactgctgactgtaagtggttgccgtttgtggcagtgagcattttgtccattctgaggttggattggtttctccttttggccttgccctgccctacagaccataaaggagaacagcaagaagcccccagcaaacatccacagatggccctggacatcagccacattctgaggaacatgtcatgttctgggagggctaaggcatcaagtaaggcctgtggggctggaggatcccaggcaaggtggggcaatccagagccatgggggcttcccatgggaattgggaggtcccaaggcagagtcagaggttccacaggaggagtcagagagtcaccaagggctctcctggcccagggagcagtcaacaccatggactgaacacttgctgggctccaacccttgggccaggctgcccatgtggggccaggaggcagctcagagtgggaggcagagagagaagtgtgctcagagggcacctgtatctggatgtaatgtggtcctgagactctggctgggaagtgcttccagggtatcatatgtgttatgcagctacttcctctccccagccttaccctgtaggaattctagtgactatgttgccaccatcttggagctccatgccctcatagtgtaatggcaccagcagatctgcctgtgcacagacttcctgtactacctcactcctgaggggagatgcttctgcgggcctgcgacctggtgctcaactttagacaccatcatcctggagcggcactgcaccctcactagccagggtgttgacgtcctcaaggccaaggccacattcaagactttggacttcattgatgcacttgtgccgagcaagcttatctgatcttctgggatctctactaggatgctggcagcccagccagctggtctggccctggacgtgccttcaggggctgggtatgcttcatgacctgtgttttgatcctggttggagtaaaacattccatgggaactcgggctgtgagaaatgtcctaaccacctgactgcagaaacatccttatcacatcctgctgggcaaaggcccaacagcctgacttcaggaacatccttatcatcttctactgagcagcaagctatactgtccagagccctccctcccagcgctatgattaccccagcctgtgagcggcagtgggcactgacactaagctggtttccccctccgcagggttttgctagtaataaacctgtgtt

SEQ ID NO: 429640 - DNA, 1914 bp, Homo sapiens
gtaagctgggcttggtatccttccctggcttcagaaagaagccaacaaggagcgttttgcagaatgaaacctttgtttccagaagcactgctgactgtaagtggttgccgtttgtggcagtgagcattttgtccattctgaggttggattggtttctccttttggccttgccctgccctacagaccataaaggagaacagcaagaagcccccagcaaacatccacagatggccctggacatcagccacattctgaggaacatgtcatgttctgggagggctaaggcatcaagtaaggcctgtggggctggaggatcccaggcaaggtggggcaatccagagccatgggggcttcccatgggaattgggaggtcccaaggcagagtcagaggttccacaggaggagtcagagagtcaccaagggctctcctggcccagggagcagtcaacaccatggactgaacacttgctgggctccaacccttgggccaggctgcccatgtggggccaggaggcagctcagagtgggaggcagagagagaagtgtgctcagagggcacctgtatctggatgtaatgtggtcctgagactctggctgggaagtgcttccagggtatcatatgtgttatgcagctacttcctctccccagccttaccctgtaggaattctagtgactatgttgccaccatcttggagctccatgccctcatagtgtaatggcaccagcagatctgcctgtgcacagacttcctgtactacctcactcctgaggggagatgcttctgcgggcctgcgacctggtgctcaactttagacaccatcatcctggagcggcactgcaccctcactagccagggtgttgacgtcctcaaggccaaggccacattcaagactttggacttcattgatgcacttgtgccgagcaagcttatctgatcttctgggatctctactaggatgctggcagcccagccagctggtctggccctggacgtgccttcaggggctgggtatgcttcatgacctgtgttttggtgagtggtaagcagcacctgcttctagcttcactgttgggccagatttcatccccaccgtggctcttcattgcggctgctttctgctccctccatggaccctgcgtggaattgccccatgtttctgtttgggcaccactgaggaaggaagcatgaaggacgcacaggtcaggccattctgttgcccacctcgtgctgggtctttactcctgggatggcttcaggggcagctccttttccatgcctccccccacccaacatctctcaggttgctgctcaaaggtcacctcttggaggggtctctccctgtcactgtgtttggaacagctccctcagtttctttctagctcatctcactctggtaatgtctttcattaccaccaccatctgacctggtcttacgacctgttagcttccttcatcagacaagagcaccaggatggcaggggcctcatctgtcctgttcctcctgtggcctgggtcctagcaccatgtctggtacagtgtaggtgctcaagggaagtttactttatagaactgtctacctgggagaggttactgttagtctaagctgcactatttggtaaaccccttgctgttttgcagatcctggttggagtaaaacattccatgggaactcgggctgtgagaaatgtcctaaccacctgactgcagaaacatccttatcacatcctgctgggcaaaggcccaacagcctgacttcaggaacatccttatcatcttctactgagcagcaagctatactgtccagagccctccctcccagcgctatgattaccccagcctgtgagcggcagtgggcactgacactaagctggtttccccctccgcagggttttgctagtaataaacctgtgtt

SEQ ID NO: 429641 - DNA, 1475 bp, Homo sapiens
gtaagctgggcttggtatccttccctggcttcagaaagaagccaacaaggagcgttttgcagaatgaaacctttgtttccagaagcactgctgactgtaagtggttgccgtttgtggcagtgagcattttgtccattctgaggttggattggtttctccttttggccttgccctgccctacagaccataaaggagaacagcaagaagcccccagcaaacatccacagatggccctggacatcagccacattctgaggaacatgtcatgttctgggagggctaaggcatcaagtaaggcctgtggggctggaggatcccaggcaaggtggggcaatccagagccatgggggcttcccatgggaattgggaggtcccaaggcagagtcagaggttccacaggaggagtcagagagtcaccaagggctctcctggcccagggagcagtcaacaccatggactgaacacttgctgggctccaacccttgggccaggctgcccatgtggggccaggaggcagctcagagtgggaggcagagagagaagtgtgctcagagggcacctgtatctggatgtaatgtggtcctgagactctggctgggaagtgcttccagggtatcatatgtgttatgcagctacttcctctccccagccttaccctgtaggaattctagtgactatgttgccaccatcttggagctccatgccctcatagtgtaatggcaccagcagatctgcctgtgcacagacttcctgtactacctcactcctgaggggagatgcttctgcgggcctgcgacctggtgctcaactttagacaccatcatcctggagcggcactgcaccctcactagccagggtgttgacgtcctcaaggccaaggccacattcaagactttggacttcattgatgcacttgtgccgagcaagcttatctgatcttctgggatctctactaggatgctggcagcccagccagctggtctggccctggacgtgccttcaggggctgggtatgcttcatgacctgtgttttggtgagtggtaagcagcacctgcttctagcttcactgttgggccagatttcatccccaccgtggctcttcattgcggctgctttctgctccctccatggaccctgcgtggaattgccccatgtttctgtttgggcaccactgaggaaggaagcatgaaggacgcacagatcctggttggagtaaaacattccatgggaactcgggctgtgagaaatgtcctaaccacctgactgcagaaacatccttatcacatcctgctgggcaaaggcccaacagcctgacttcaggaacatccttatcatcttctactgagcagcaagctatactgtccagagccctccctcccagcgctatgattaccccagcctgtgagcggcagtgggcactgacactaagctggtttccccctccgcagggttttgctagtaataaacctgtgtt

SEQ ID NO: 429642 - DNA, 1201 bp, Homo sapiens
gtaagctgggcttggtatccttccctggcttcagaaagaagccaacaaggagcgttttgcagaatgaaacctttgtttccagaagcactgctgactgtaagtggttgccgtttgtggcagtgagcattttgtccattctgaggttggattggtttctccttttggccttgccctgccctacagaccataaaggagaacagcaagaagcccccagcaaacatccacagatggccctggacatcagccacattctgaggaacatgtcatgttctgggagggctaaggcatcaagtaaggcctgtggggctggaggatcccaggcaaggtggggcaatccagagccatgggggcttcccatgggaattgggaggtcccaaggcagagtcagaggttccacaggaggagtcagagagtcaccaagggctctcctggcccagggagcagtcaacaccatggactgaacacttgctgggctccaacccttgggccaggctgcccatgtggggccaggaggcagctcagagtgggaggcagagagagaagtgtgctcagagggcacctgtatctggatgtaatgtggtcctgagactctggctgggaagtgcttccagggtatcatatgtgttatgcagctacttcctctccccagccttaccctgtaggaattctagtgactatgttgccaccatcttggagctccatgccctcatagtgtaatggcaccagcagatctgcctgtgcacagacttcctgtactacctcactcctgaggggagatgcttctgcgggcctgcgacctggtgctcaactttagacaccatcatcctggagcggcactgcaccctcactagccagggtgttgacgtcctcaaggccaaggccacattcaagactttggacttcattgatgcacttgtgccgagcaagatcctggttggagtaaaacattccatgggaactcgggctgtgagaaatgtcctaaccacctgactgcagaaacatccttatcacatcctgctgggcaaaggcccaacagcctgacttcaggaacatccttatcatcttctactgagcagcaagctatactgtccagagccctccctcccagcgctatgattaccccagcctgtgagcggcagtgggcactgacactaagctggtttccccctccgcagggttttgctagtaataaacctgtgtt

SEQ ID NO: 429643 - DNA, 469 bp, Homo sapiens
aaacctaacctctttgaggaaccacagagcccaagactggaagccttcagaatcttctggcccccaaccctccctggggacccctgtggcctgtctcaccagagcactcttctgtctgtagatgtctcagctgctctacaagggagtcccatttcaggtgtggggctgggcatggtcactcctgctggatgtctagaaggtggaaactaaggacctaggaaaatgccagatacagcctttccaccctcatccagagcaggacaaacaggcccggtggtgtcaggagcccaggtctccagctggagggaacgtcaaccctgcagtgggagcaggggcccatcgcacatcctaggcacagatgctaatgcaggcactgcaggtaagctgggcttggtatccttccctggcttcagaaagaagccaacaaggagcgttttgcagaatgaaacctttgtttccagaagcactg

SEQ ID NO: 429644 - DNA, 851 bp, Homo sapiens
ggtggcaggtgagcggcgggcggggatggcggagcaatgggagctggacgaggaaggcattcgccgcctgggggcgctgacgctggagcagccggagacaggttcttgctatgttgcccaggctggacttgaacttctggactcaagcaatcctgtctcagcctccccagtaactgagactacagaactggtggagtctctttcattgcagggatcttatgctggcaaaatccattccattggtgatgccttcagaaattttaaaaatctccgatccttagatttatcaaggaatttgatcactagccttaagggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagggtaatgtattcactctcctgctgatctgttgac

SEQ ID NO: 429645 - DNA, 2405 bp, Homo sapiens
ggtggcaggtgagcggcgggcggggatggcggagcaatgggagctggacgaggaaggcattcgccgcctgggggcgctgacgctggagcagccggaactggtggagtctctttcattgcagggatcttatgctggcaaaatccattccattggtgatgccttcagaaattttaaaaatctccgatccttagatttatcaaggaatttgatcactagccttaagggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctgatta

SEQ ID NO: 429646 - DNA, 1299 bp, Homo sapiens
aataagctcacatttgaacgcgcatggacttccttctacctaaactttcgaactttttttagacacaggaagtagcaagaagggagatgccaagtgacaatcaccaggaagatgatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctgatta

SEQ ID NO: 429647 - DNA, 2222 bp, Homo sapiens
ggtggcaggtgagcggcgggcggggatggcggagcaatgggagctggacgaggaaggcattcgccgcctgggggcgctgacgctggagcagccggaactggtggagtctctttcattgcagggatcttatgctggcaaaatccattccattggtgatgccttcagaaattttaaaaatctccgatccttagatttatcaaggaatttgatcactagccttaagggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctgatta

SEQ ID NO: 429648 - DNA, 258 bp, Homo sapiens
tgatttcatgactgcctttttcccttgggcctcagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagc

SEQ ID NO: 429649 - DNA, 214 bp, Homo sapiens
tttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctga

SEQ ID NO: 429650 - DNA, 2032 bp, Homo sapiens
aacacaccaagatgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggaaagagtcttgctctgtcgcccagactggagtgctgtggcgcgatctcggctcactgcaacctctacctcctgggttcaagcagttctcctgcctcagcctagcgagcagctgggattacagactcaaacaaaggactttttattcccttccccaaccgggaaataaaggattccctaagtacttctgcaactcagggcaatggtacacgtgatcagaaattagacaccttcccactggggacacagagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctgatta

SEQ ID NO: 429651 - DNA, 1667 bp, Homo sapiens
aacacaccaagatgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctgatta

SEQ ID NO: 429652 - DNA, 1457 bp, Homo sapiens
ggtggcaggtgagcggcgggcggggatggcggagcaatgggagctggacgaggaaggcattcgccgcctgggggcgctgacgctggagcagccggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctgatta

SEQ ID NO: 429653 - DNA, 824 bp, Homo sapiens
  misc_feature (803)..(803): n is a, c, g, or t
attacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttgggaggctgaggtgggaggatttcttgagcccaggaggtcaaggttgcagtgacctatgactgcaccactgcactccagcctggacaacagagtgaggccctgtctcaaaaaaataaataaataggagtttgaggccatgttcacacatcactgcagtccagtctggtaaacagagcaagacgctgagtctttaacaaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctgtaatcctagcactttgggaggccaagtgggaggatagcttgaggccaatagttcaagaacaccctgggcaacatagtgaagccccttttctacaaaaaataaataaataggagtttgaggccatgttcacacatcactgcagtccagtctggtaaacagagcaagacgntgagtctttaacaaaaaaaaa

SEQ ID NO: 429654 - DNA, 685 bp, Homo sapiens
  misc_feature (664)..(664): n is a, c, g, or t
attacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgggaggatttcttgagcccaggaggtcaaggttgcagtgacctatgactgcaccactgcactccagcctggacaacagagtgaggccctgtctcaaaaaaataaataaataggagtttgaggccatgttcacacatcactgcagtccagtctggtaaacagagcaagacgctgagtctttaacaaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctgtaatcctagcactttgggaggccaagtgggaggatagcttgaggccaatagttcaagaacaccctgggcaacatagtgaagccccttttctacaaaaaataaataaataggagtttgaggccatgttcacacatcactgcagtccagtctggtaaacagagcaagacgntgagtctttaacaaaaaaaaa

SEQ ID NO: 429655 - DNA, 502 bp, Homo sapiens
cctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttgggaggctgaggtgggaggatttcttgagcccaggaggtcaaggttgcagtgacctatgactgcaccactgcactccagcctggacaacagagtgaggccctgtctcaaaaaaataaataaataggagtttgaggccatgttcacacatcactgcagtccagtctggtaaacagagcaagacgctgagtctttaacaaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaac

SEQ ID NO: 429656 - DNA, 964 bp, Homo sapiens
taacggtctaggtacgaggctgggtggtggtggtcgtgggcggcggcggcgtgggcaagagcgcgctgaccatccagttcatccagtcctacttcgtgtctgactacgaccccactattgaggactcctacacgaagatctgcagtgtggatggcatcccagcccggctggacatcctggacaccgcgggccaggaagagttcggggccatgagagagcagtacatgcgtgctggccacggcttcctgctggtgttcgccattaatgaccggcagagtttcaacgaggtgggcaagctcttcacgcagattctgcgggtcaaggaccgcgacgacttccccgttgtgttggtcgggaacaaggcagatctggagtcacagcgccaggtcccccgatcagaagcctctgccttcggcgcctcccaccacgtggcctactttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcaaaaaaaaaaaccgaggtttttggtggggaaaggtggatggccggtctagttcgcacattttggaaagggaatgcggcccaaggggaaaga

SEQ ID NO: 429657 - DNA, 1135 bp, Homo sapiens
cagagctcatgattatgcagtagcctcattagcgtagcccgcccccccgggtcccgcccggctcccccgcaggcggtagcgaaggcagcagcagcggtggcgacatgagcagcggggcggcgtccgggacagggcgggggcggccccggggcgggggacctgggcccggggaccccccgcccagcgagacacacaagctggtggtcgtgggcggcggcggcgtgggcaagagcgcgctgaccatccagttcatccagtcctacttcgtgtctgactacgaccccactattgaggactcctacacgaagatctgcagtgtggatggcatcccagcccggctggacatcctggacaccgcgggccaggaagagttcggggccatgagagagcagtacatgcgtgctggccacggcttcctgctggtgttcgccattaatgaccggcagagtttcaacgaggtgggcaagctcttcacgcagattctgcgggtcaaggaccgcgacgacttccccgttgtgttggtcgggaacaaggcagatctggagtcacagcgccaggtcccccgatcagaagcctctgccttcggcgcctcccaccacgtggcctactttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcaaaaaaaaaaaccgaggtttttggtggggaaaggtggatggccggtctagttcgcacattttggaaagggaatgcggcccaaggggaaaga

SEQ ID NO: 429658 - DNA, 1087 bp, Homo sapiens
cagagctcatgattatgcagtagcctcattagcgtagcccgcccccccgggtcccgcccggctcccccgcaggcggtagcgaaggcagcagcagcggtggcgacatgagcagcggggcggcgtccgggacagggcgggggcggccccggggcgggggacctgggcccggggaccccccgcccagcgagacacacaagctggtggtcgtgggcggcggcggcgtgggcaagagcgcgctgaccatccagttcatccagtcctacttcgtgtctgactacgaccccactattgaggactcctacacgaagatctgcagtgtggatggcatcccagcccggctggacatcctggacaccgcgggccaggaagagttcggggccatgagagagcagtacatgcgtgctggccacggcttcctgctggtgttcgccattaatgaccggcagagtttcaacgaggtgggcaagctcttcacgcagattctgcgggtcaaggaccgcgacgacttccccgttgtgttggtcgggaacaaggcagatctggagtcacagcgccaggtcccccgatcagaagcctctgccttcggcgcctcccaccacgtggcctactttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaatatgtcctcccacgtcacaatattacaacacttaaaaaatcgggtttttggtggacacagttttc

SEQ ID NO: 429659 - DNA, 959 bp, Homo sapiens
cacttcgacctcgcagagaggctgactgagagccgagtgttagtggtgggcaagagcgcgctgaccatccagttcatccagtcctacttcgtgtctgactacgaccccactattgaggactcctacacgaagatctgcagtgtggatggcatcccagcccggctggacatcctggacaccgcgggccaggaagagttcggggccatgagagagcagtacatgcgtgctggccacggcttcctgctggtgttcgccattaatgaccggcagagtttcaacgaggtgggcaagctcttcacgcagattctgcgggtcaaggaccgcgacgacttccccgttgtgttggtcgggaacaaggcagatctggagtcacagcgccaggtcccccgatcagaagcctctgccttcggcgcctcccaccacgtggcctactttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcaaaaaaaaaaaccgaggtttttggtggggaaaggtggatggccggtctagttcgcacattttggaaagggaatgcggcccaaggggaaaga

SEQ ID NO: 429660 - DNA, 1251 bp, Homo sapiens
cagagctcatgattatgcagtagcctcattagcgtagcccgcccccccgggtcccgcccggctcccccgcaggcggtagcgaaggcagcagcagcggtggcgacatgagcagcggggcggcgtccgggacagggcgggggcggccccggggcgggggacctgggcccggggaccccccgcccagcgagacacacaagctggtggtcgtgggcggcggcggcgtgggcaagagcgcgctgaccatccagttcatccagtcctacttcgtgtctgactacgaccccactattgaggactcctacacgaagatctgcagtgtggatggcatcccagcccggctggacagtgagggcggcaaggatggatgatggatgggggtggtgtcagtgggggctgagggctcttgggggtgactgcggggagcctggtccccacgatggcccctctccctgtctctgcagtcctggacaccgcgggccaggaagagttcggggccatgagagagcagtacatgcgtgctggccacggcttcctgctggtgttcgccattaatgaccggcagagtttcaacgaggtgggcaagctcttcacgcagattctgcgggtcaaggaccgcgacgacttccccgttgtgttggtcgggaacaaggcagatctggagtcacagcgccaggtcccccgatcagaagcctctgccttcggcgcctcccaccacgtggcctactttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcaaaaaaaaaaaccgaggtttttggtggggaaaggtggatggccggtctagttcgcacattttggaaagggaatgcggcccaaggggaaaga

SEQ ID NO: 429661 - DNA, 1080 bp, Homo sapiens
cagagctcatgattatgcagtagcctcattagcgtagcccgcccccccgggtcccgcccggctcccccgcaggcggtagcgaaggcagcagcagcggtggcgacatgagcagcggggcggcgtccgggacagggcgggggcggccccggggcgggggacctgggcccggggaccccccgcccagcgagacacacaagctggtggtcgtgggcggcggcggcgtgggcaagagcgcgctgaccatccagttcatccagtcctacttcgtgtctgactacgaccccactattgaggactcctacacgaagatctgcagtgtggatggcatcccagcccggctggacatcctggacaccgcgggccaggaagagttcggggccatgagagagcagtacatgcgtgctggccacggcttcctgctggtgttcgccattaatgaccggcagagtttcaacgaggtgggcaagctcttcacgcagattctgcgggtcaaggaccgcgacgacttccccgttgtgttggtcgggaacaaggcagatctggagtcacagcgccaggtcccccgatcagaagcctctgccttcggcgcctcccaccacgtggcctactttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcactcttctgggctactgccactgtgtgccttctgccaacgcctcctgtccccacctaagcctggtgggggtgaggggctccgggtcactgctgtatataactcccctcccccagaaaaataaatgtcactgccaacgtcaaaaaaaaaaaccgaggtttttggtggggaaaggtggatggccggtctagttcgcacattttggaaagggaatgcggcccaaggggaaaga

SEQ ID NO: 429662 - DNA, 625 bp, Homo sapiens
  misc_feature (46)..(47): n is a, c, g, or t
tatcgagctcggccgtgttaagtaggcaattggagtcacagcgccnngtcccccgatcagaagcctctgccttcggcgcctcccaccacgtggcctactttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcaaaaaaaaaaaccgaggtttttggtggggaaaggtggatggccggtctagttcgcacattttggaaagggaatgcggcccaaggggaaaga

SEQ ID NO: 429663 - DNA, 872 bp, Homo sapiens
cagagctcatgattatgcagtagcctcattagcgtagcccgcccccccgggtcccgcccggctcccccgcaggcggtagcgaaggcagcagcagcggtggcgacatgagcagcggggcggcgtccgggacagggcgggggcggccccggggcgggggacctgggcccggggaccccccgcccagcgagacacacaagctggtggtcgtgggcggcggcggcgtgggcaagagcgcgctgaccatccagttcatccagtcctacttcgtgtctgactacgaccccactattgaggactcctacacgaagatctgcagtgtggatggcatcccagcccggctggacatttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcaaaaaaaaaaaccgaggtttttggtggggaaaggtggatggccggtctagttcgcacattttggaaagggaatgcggcccaaggggaaaga

SEQ ID NO: 429664 - DNA, 342 bp, Homo sapiens
aatggggttttgctccgaatcttgccagtgctggatggagtgtagtgctgttcttagcatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcaaaaaaaaaaaccgaggtttttggtggggaaaggtggatggccggtctagttcgcacattttggaaagggaatgcggcccaaggggaaaga

SEQ ID NO: 429665 - DNA, 1289 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429666 - DNA, 1008 bp, Homo sapiens
aaatcaacactggataaataaaagccctgctctgatagcaaaggacaatggtcagtgattttcacactgactctgatggttgatagagctaggaaatagatttcaaaaagcaaaacctgtagctgctgcaggatctgcccagcctgcccgggattgcccacctgttcccagccagaccctctcacctgctctggtctctacagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggtcagtgtctccccactgccctccctagtcactgggcccatcacaagggcattctgagctcagtattgagcctactggagccacctctcgctcaatagcgcattcagcagaaactctacaggattgtacacacagtagtaacactggccttggaaaaaaaaagttaatgtacgtgttttcctggttacaaaagcaatgcaccttcactgtagataataaaatagagataaacattaaaaaattatgtcacccataatcccactgcccatggctcggaatattaatgtttttctgtctaccttcccagtgtttctccgctcctgtatatgtttatactgtacatatacttaccttttacttaagactccatcaggagcattttttcatgccattaagtattcgccctgacaccacggagtttgttatgtagattagtttattcctgagtaccttactgctggatactgtttctagtttttggcttctataaataaatgttgcagtaaacatccttatgtggaaaaggctttgcatgtccattaatacattattatttcctttgaataaaccctttggaatttaaatatg

SEQ ID NO: 429667 - DNA, 1415 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccagcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429668 - DNA, 1549 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagcaaaaaaaaaaaggcacaaacacacaaccacaagccaaccaaacacacacgaaaggaaacaagaaacggcaaaacacaagagaacacacgccgcaacccacacgagcaccatacgcagacaaaaaaccgagggcaagcacccgcccacgagaggggagacaaaagagaaagaggaacaacacacagacgaccaagcggggagcaccgagcgcgaaagagcaaaggacaacggacacagagaaagaacacaccacacactcaa

SEQ ID NO: 429669 - DNA, 1409 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggtaggacgagcctggctgggtctaggccagaagggtgtccgtggcgccggtctcccgcggagcgcagaactagtaccggatccccagccgcttctgaccacacagacggggcggacctgtgctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429670 - DNA, 1419 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaaggtaggttagcgaaaagcaaagagcaagggccccaaaggcctggcaggcttgcctcagacttgagaagtacaggcttgtgtatgtgtgtctgacggaagggctgacactgtcatggcctgctctgttgcagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429671 - DNA, 1544 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtgagtgacaggggctgtcctgcagcccgttcacctgcacacatgtggaggctgacctgagccctccatctttgggtgtggcacctcagccagccctggtctcacgggtccttctgcttgatccagtttgttaccttttacccaggggatgtcatcctaactgggacccccccaggtgtcggtgtattcaggaaacctcctgtctttctcaaggtaggttagcgaaaagcaaagagcaagggccccaaaggcctggcaggcttgcctcagacttgagaagtacaggcttgtgtatgtgtgtctgacggaagggctgacactgtcatggcctgctctgttgcagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429672 - DNA, 1252 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccagcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429673 - DNA, 1414 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtgagtgacaggggctgtcctgcagcccgttcacctgcacacatgtggaggctgacctgagccctccatctttgggtgtggcacctcagccagccctggtctcacgggtccttctgcttgatccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429674 - DNA, 983 bp, Homo sapiens
cggtacccgctgagatgacagtcggcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429675 - DNA, 1176 bp, Homo sapiens
  misc_feature (1063)..(1063): n is a, c, g, or t
  misc_feature (1073)..(1073): n is a, c, g, or t
  misc_feature (1083)..(1083): n is a, c, g, or t
  misc_feature (1114)..(1114): n is a, c, g, or t
  misc_feature (1125)..(1125): n is a, c, g, or t
  misc_feature (1128)..(1129): n is a, c, g, or t
  misc_feature (1131)..(1131): n is a, c, g, or t
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccagcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaagatccacacaacttaaagatctgctgccgagtgaatggggaagtggtccagagcggcaacaccaaccagatggtattcaagacagaggacctgatagcctgggtctcccagtgagtgacaggggctgtcctgcagcccgttcacctgcacacatgtggaggctgacctgagccctccatctttgggtgtggcacctcagccagccctggtctcacgggtccttctgcttgatccaacggtggngcctttcccngggtgtgtcnaatgggcccccgggtgggttccggaccccgngttctcgggtngannanagagggccagcgggtcccataaaaagcgggtgttacggggcacaa

SEQ ID NO: 429676 - DNA, 1269 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429677 - DNA, 1074 bp, Homo sapiens
aaatcaacactggataaataaaagccctgctctgatagcaaaggacaatggtcagtgattttcacactgactctgatggttgatagagctaggaaatagatttcaaaaagcaaaacctgtagctgctgcaggatctgcccagcctgcccgggattgcccacctgttcccagccagaccctctcacctgctctggtctctacagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429678 - DNA, 913 bp, Homo sapiens
ttgctcttctgcagtcagtggtgtggggacctgtgcctgcatcccatgatgctgtctgccactgcccaaaatgtatgggtctacaagtcacacctcccttgtcattcactgggctctggttcgtggtgatggcaaacatgggatggcagcgaagccatactgacaaaggttgaggcccttcagcatggtgtgcagcctctcagcatggacagtgggccctgaagccactgcagctcactgttcctctcccaccctacaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429679 - DNA, 1126 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429680 - DNA, 999 bp, Homo sapiens
tgttatttcatcagggctgggctttattgtatatactggccctgttcttcatagtctagatagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagca

SEQ ID NO: 429681 - DNA, 1349 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccagcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggtcagtgtctccccactgccctccctagtcactgggcccatcacaagggcattctgagctcagtattgagcctactggagccacctctcgctcaatagcgcattcagcagaaactctacaggattgtacacacagtagtaacactggccttggaaaaaaaaagttaatgtacgtgttttcctggttacaaaagcaatgcaccttcactgtagataataaaatagagataaacattaaaaaattatgtcacccataatcccactgcccatggctcggaatattaatgtttttctgtctaccttcccagtgtttctccgctcctgtatatgtttatactgtacatatacttaccttttacttaagactccatcaggagcattttttcatgccattaagtattcgccctgacaccacggagtttgttatgtagattagtttattcctgagtaccttactgctggatactgtttctagtttttggcttctataaataaatgttgcagtaaacatccttatgtggaaaaggctttgcatgtccattaatacattattatttcctttgaataaaccctttggaatttaaatatg

SEQ ID NO: 429682 - DNA, 1104 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccagcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgccctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagcaaaaaaaaaaaggcacaaacacacaaccacaagccaaccaaacacacacgaaaggaaacaagaaacggcaaaacacaagagaacacacgccgcaacccacacgagcaccatacgcagacaaaaaaccgagggcaagcacccgcccacgagaggggagacaaaagagaaagaggaacaacacacagacgaccaagcggggagcaccgagcgcgaaagagcaaaggacaacggacacagagaaagaacacaccacacactcaa

SEQ ID NO: 429683 - DNA, 1047 bp, Homo sapiens
ccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccagcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagcaaaaaaaaaaaggcacaaacacacaaccacaagccaaccaaacacacacgaaaggaaacaagaaacggcaaaacacaagagaacacacgccgcaacccacacgagcaccatacgcagacaaaaaaccgagggcaagcacccgcccacgagaggggagacaaaagagaaagaggaacaacacacagacgaccaagcggggagcaccgagcgcgaaagagcaaaggacaacggacacagagaaagaacacaccacacactcaa

SEQ ID NO: 429684 - DNA, 477 bp, Homo sapiens
ggagtgtcagccccacaagggcaaggatgtttgttttgtttgtagctccatactcggtacccaggatgctgcctggcatatagtagggtcttgatattaagtgatttactccatacggttcccctagcatgcaggatggtacctggcattcagtaggagctcaagagatgtttgttgaatgaattggtgtgataggggacttggtgaggacccgcccccacttagatagctttagaagctgttggatacttcatccctctgcgtggtgctgcagacatggagatgaagaggtggcctcagtgtgggagtagaggggagcattcccttgactgaggaaggaatgttagaaaagagagctgaggctgggcatggtggctcatgtctgtaaacccagcactttgggaggccgaggtgggcagatcatgaggtcaggagtttgagatcagcctgaccaacattgtgaaccccgtctctact

SEQ ID NO: 429685 - DNA, 577 bp, Homo sapiens
tgtctgtatcctcctgctctctgtaccaagaccacacaatagtcagagaagcctggtcaggacccaggccccagtcctcaccttgtggcctcccacaggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaaacgagaagaccccaaaaccaggagagactctgtggactccaagtcttctgcctcctcctctccaaaaagaccatcggtggaaaggtaaaggaaaccacagctttctccatcccagtgtcctattcagcctgtgtccccttctctgtttttatggaggaagcccaaggcagaggaaaggagggaaggaa

SEQ ID NO: 429686 - DNA, 356 bp, Homo sapiens
cgccgtgacgcagctgtccctttgcctgctactaaatgatttgcggtgggtgaggtggcagctggggacccccttgaggagaaaaaggagaggaaagagaaaaggcaaagaagaaggaaaaagggcttgagtgttcagactggaagccagaagcaggcctttctccaccaaggaaaaaaacgagaagaccccaaaaccaggtattcttttttgggatggagagaagggagctgacacttgtcacgtcctctgacagcaactcagtgtatattatctcatttaaacctttcatcctggggaggaagatattggtattatctcctgcagtgccccctctgggggtcttctttggctca

SEQ ID NO: 429687 - DNA, 793 bp, Homo sapiens
tccttgccaattttcttctttcaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaa

SEQ ID NO: 429688 - DNA, 1566 bp, Homo sapiens
  misc_feature (100)..(100): n is a, c, g, or t
cgtgtgtgtttggggcccgcgcgggttgcgcgccctccgccttcgcgcctcctgcccccgaggccctactgctgcccctgtgcccctcgccccgccgggngtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaaacgagaagaccccaaaaccaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaactctgtctgagtgggatggtatgagttagaggaagaattctcttgcaaattaataatcggtcattagaaacaattggttaatgggggagcctaattggagaatgatgctgagaatttgtattgatgaacctcttttagaaactgcagagggctgggcacggtggcttatggctgtaatctgcaaactctgggaggctgaggtgggagaatcgcttaaccccagaagtttgagtccagcccaggcaacacagcaagaccccatctctataaaaagaaaaaataaagaaactgcagcgccttaga

SEQ ID NO: 429689 - DNA, 1051 bp, Homo sapiens
gctgccgcctactactactaaattagcggccggtcgatccgtttcaaaaaaaaaaaaaaaaattgggagtgatattagtgcctatctcagagtgattgtaagggtgaaatgagttaatacatgttaatactgcctagcacagaataaatgctcaataaatgtagctcttgtgattttgttactgttagagaaaggacattctgaatgctttaaatccagctcctcttccttgactcttactagttggagggacaggatccactagaggtaacaactacagacttctgaacacattttcagttggtctccgttgccatgtgggagaccaaaagtctaaccaagtgattagtagccatcccagtgatgttcttgaccataaattgagagctcagcacattcctggcaccgaattgccattcatttattacctgatatcattctcacattcacaagctttatgagctcattttacaggtgagtgatttgttcaagatcacacagctaataatggcagagctgggctttggactctggtctgtgtggctccagacaccaccttctttttcatattcccccacagcctccttggaggatgccgagaaacctttcaaattttgttgcctttctggttttgtagttctgctgatggaacagccagccatgaacaaggtgaggaagaagaaagaggaagcgctgaattatctgaactggagaagcaataaaaattaaagtgaaggaaaatactgaactctgtctgagtgggatggtatgagttagaggaagaattctcttgcaaattaataatcggtcattagaaacaattggttaatgggggagcctaattggagaatgatgctgagaatttgtattgatgaacctcttttagaaactgcagagggctgggcacggtggcttatggctgtaatctgcaaactctgggaggctgaggtgggagaatcgcttaaccccagaagtttgagtccagcccaggcaacacagcaagaccccatctctataaaaagaaaaaataaagaaactgcagcgccttaga

SEQ ID NO: 429690 - DNA, 748 bp, Homo sapiens
gctgccgcctactactactaaattagcggccggtcgatccgtttcaaaaaaaaaaaaaaaaattgggagtgatattagtgcctatctcagagtgattgtaagggtgaaatgagttaatacatgttaatactgcctagcacagaataaatgctcaataaatgtagctcttgtgattttgttactgttagagaaaggacattctgaatgctttaaatccagctcctcttccttgactcttactagttggagggacaggatccactagaggtaacaactacagacttctgaacacattttcagttggtctccgttgccatgtgggagaccaaaagtctaaccaagtgattagtagccatcccagtgatgttcttgaccataaattgagagctcagcacattcctggcaccgaattgccattcatttattacctgatatcattctcacattcacaagctttatgagctcattttacaggtgagtgatttgttcaagatcacacagctaataatggcagagctgggctttggactctggtctgtgtggctccagacaccaccttctttttcatattcccccacagcctccttggaggatgccgagaaacctttcaaattttgttgcctttctggttttgtagttctgctgatggaacagccagccatgaacaaggtgaggaagaagaaagaggaagcgctgaattatctgaactggagaagcaataaaaattaaagtgaaggaaaatactgaa

SEQ ID NO: 429691 - DNA, 1222 bp, Homo sapiens
  misc_feature (100)..(100): n is a, c, g, or t
cgtgtgtgtttggggcccgcgcgggttgcgcgccctccgccttcgcgcctcctgcccccgaggccctactgctgcccctgtgcccctcgccccgccgggngtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaaacgagaagaccccaaaaccaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagagagatgagggaagcgggagtgatgaagacgagaatgatgaaggcaatgatgaagattatagtagccctgccagtgaagggggttgcaagaagaagaagagtaaagttcctagcagaaacagtgctgatgatgaggaactgaccaatgatagcctgaccctatctcaaagcaagagtaatgaggactcgctgattcttgagaagagtcaaaactggagctctccaaaaatggaccatattctgatttgctgtgtttgttgggcggatgatagtgaggaccgatgaaataag

SEQ ID NO: 429692 - DNA, 624 bp, Homo sapiens
  misc_feature (100)..(100): n is a, c, g, or t
cgtgtgtgtttggggcccgcgcgggttgcgcgccctccgccttcgcgcctcctgcccccgaggccctactgctgcccctgtgcccctcgccccgccgggngtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaa

SEQ ID NO: 429693 - DNA, 874 bp, Homo sapiens
  misc_feature (100)..(100): n is a, c, g, or t
cgtgtgtgtttggggcccgcgcgggttgcgcgccctccgccttcgcgcctcctgcccccgaggccctactgctgcccctgtgcccctcgccccgccgggngtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaaacgagaagaccccaaaaccaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatatccttgaactgtgccggggctgtgggtgtctgcaccgtctagcagcacccatccaaggtgcaagcgagctgggagagtgaggaaggagaggaa

SEQ ID NO: 429694 - DNA, 282 bp, Homo sapiens
agatcatgccattgcactccagcctgggtgacaagtgaaactccgtttcaaaaaaaaaaaaaaaaattgggagtgatattagtgcctatctcagagtgattgtaagggtgaaatgagttaatacatgttaatactgcctagcacagaataaatgctcaataaatgtagctcttgtgattttgttactgttagagaaaggacattctgaatgctttaaatccagctcctcttccttgactcttactagttggagggacaggatccactagaggtaacaactac

SEQ ID NO: 429695 - DNA, 396 bp, Homo sapiens
ccaagtgattagtagccatcccagtgatgttcttgaccataaattgagagctcagcacattcctggcaccgaattgccattcatttattacctgatatcattctcacattcacaagctttatgagctcattttacaggtgagtgatttgttcaagatcacacagctaataatggcagagctgggctttggactctggtctgtgtggctccagacaccaccttctttttcatattcccccacagcctccttggaggatgccgagaaacctttcaaattttgttgcctttctggttttgtagttctgctgatggaacagccagccatgaacaaggtgaggaagaagaaagaggaagcgctgaattatctgaactggagaagcaataaaaattaaagtg

SEQ ID NO: 429696 - DNA, 1263 bp, Homo sapiens
  misc_feature (100)..(100): n is a, c, g, or t
cgtgtgtgtttggggcccgcgcgggttgcgcgccctccgccttcgcgcctcctgcccccgaggccctactgctgcccctgtgcccctcgccccgccgggngtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaaacgagaagaccccaaaaccaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaa

SEQ ID NO: 429697 - DNA, 1314 bp, Homo sapiens
ggaatgggaggggtcctgacagtcagccaagtgccacccccaaccctaggttcaggtttcaccaaagctacagatatcctccatgtcaggcttagccctgggccctcggcctcgtgcagagcagggccttagttacagtagtggggttctgacctcagccaggagtcagggctaggactctgggggtccaggttggaaggggaggtggtggtagagctggggcaggatctgccaatgatggcagccattcctgtgtatccattcccagattatgccttaaccctctcactttgcagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaaacgagaagaccccaaaaccaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaa

SEQ ID NO: 429698 - DNA, 690 bp, Homo sapiens
cgtgtgtgtttggggcccgcgcgggttgcgcgccctccgccttcgcgcctcctgcccccgaggccctactgctgcccctgctatctcacaggggactctgtccgggacaagtgtgtggagatgctgtcagcagccctgaaggcggacgatgattacaaggactatggagtcaactgtgacaagatggcatcagaaatcgaagatcatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaa

SEQ ID NO: 429699 - DNA, 1948 bp, Homo sapiens
  misc_feature (100)..(100): n is a, c, g, or t
cgtgtgtgtttggggcccgcgcgggttgcgcgccctccgccttcgcgcctcctgcccccgaggccctactgctgcccctgtgcccctcgccccgccgggngtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaaacgagaagaccccaaaaccaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaactctgtctgagtgggatggtatgagttagaggaagaattctcttgcaaattaataatcggtcattagaaacaattggttaatgggggagcctaattggagaatgatgctgagaatttgtattgatgaacctcttttagaaactgcagagggctgggcacggtggcttatggctgtaatctgcaaactctgggaggctgaggtgggagaatcgcttaaccccagaagtttgagtccagcccaggcaacacagcaagaccccatctctataaaaagaaaaaataaagaaactgcagcgccttagacctgaggtgtcatatctttgacagtgggctggcagacctttgctttgagttccttctctcccatctggatctcccagccttttccaaattgaaaaatgccagatcaacacaaaccttaccccacccccacctccgagtcacacgtgcagaactgttgatacaccatttggcttcagcagatattacttccatactacgtattaggttgctgcaaaagtaattgtggtttttgcagttacttttgcagtggcctaatagaaatatttcttccctactctttcctcatctcttcccaaactctctgctattccctgttcacagctggctgtgggggcctttgaggactccagatcatatccctctaggcagggaacagatcctc

SEQ ID NO: 429700 - DNA, 1039 bp, Homo sapiens
  misc_feature (100)..(100): n is a, c, g, or t
cgtgtgtgtttggggcccgcgcgggttgcgcgccctccgccttcgcgcctcctgcccccgaggccctactgctgcccctgtgcccctcgccccgccgggngtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaaacgagaagaccccaaaaccaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaa

SEQ ID NO: 429701 - DNA, 681 bp, Homo sapiens
caggaactcggctttcagtctggccccacctccccaggcctctcatcaggtttctcaccaacttcctcttcccccaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggtgaagcctctgtgcagctgatgcttccctggtctctgtaccctaccttgtcacaggcactggcccacgcgcagcacctgtacagtgcccttgcagcaactgtcagttcctggaacctggagaacctctcacttgagggcatagctgagtaacagcctcagtgtgccctgaccc

SEQ ID NO: 429702 - DNA, 3606 bp, Homo sapiens
atcattgataggcgccgggcagctgagctggtaggaggaccagacggggatgttcggctccgcccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtttgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 429703 - DNA, 3534 bp, Homo sapiens
atcattacctgactaaaagcccctcaggaccagggactgatctcggtcataatcattattgtgtagcaaggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtttgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 429704 - DNA, 3985 bp, Homo sapiens
atcattgataggcgccgggcagctgagctggtaggaggaccagacggggatgttcggctccgcccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcgtgagtgatcgtcctgtgtccactcttcttcccctttcctgcccagtcctcccccaccttgcaccctcttgccatccctgggtgaggggccaaggacctggaccctgcttactgtgttcttaatacctggagctcagcaggatgggcctaccacatactccctccccctttttgtctttgctcagttccttctcgatggcaaggtcttgtcactgacagattttcaggtcggtgtggttggggggcgaggactgttgggggaagacacgaagggagggcgctggggagagaacagagggctggctggtgacagggtcttcctggtcagtggaaagtagggtcccgccttttggctggcttgggcaaggcagaggtgctcccaggctccaacctctctctccttcctgtcgtcacgtgccagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtttgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 429705 - DNA, 3393 bp, Homo sapiens
agttttatataggccaaggttgaggcctagtccagaagaggtctcagaggaccctggctagagtttggtcaacgagataatctttttctcccctgtacccctgccaggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcgtgagtgatcgtcctgtgtccactcttcttcccctttcctgcccagtcctcccccaccttgcaccctcttgccatccctgggtgaggggccaaggacctggaccctgcttactgtgttcttaatacctggagctcagcaggatgggcctaccacatactccctccccctttttgtctttgctcagttccttctcgatggcaaggtcttgtcactgacagattttcaggtcggtgtggttggggggcgaggactgttgggggaagacacgaagggagggcgctggggagagaacagagggctggctggtgacagggtcttcctggtcagtggaaagtagggtcccgccttttggctggcttgggcaaggcagaggtgctcccaggctccaacctctctctccttcctgtcgtcacgtgccagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtttgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 429706 - DNA, 3750 bp, Homo sapiens
atcattgataggcgccgggcagctgagctggtaggaggaccagacggggatgttcggctccgcccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtttgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggtgaagcctctgtgcagctgatgcttccctggtctctgtaccctaccttgtcacaggcactggcccacgcgcagcacctgtacagtgcccttgcagcaactgtcagttcctggaacctggagaacctctcacttgagggcataggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 429707 - DNA, 3859 bp, Homo sapiens
atcattgataggcgccgggcagctgagctggtaggaggaccagacggggatgttcggctccgcccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtttgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcataaaaaaaaaaaaataaaaaataaaaaaacaatatcaataaaatactaacaacctttctgggggggcccctttacatctaacttggccttttatttcgcccgtttttaacattcatatacccttggtgttctccatcctcatactggttacaccctgttcatgcccccacaaattcggggcttgaaggatatcccccctcttcctctttgggactttctctattatggccattctctaatgttccattttaaaca

SEQ ID NO: 429708 - DNA, 1524 bp, Homo sapiens
tgtgatctagaggatcgtgtaactgggttcgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtttgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 429709 - DNA, 1977 bp, Homo sapiens
tggctgttgtgtgccctgcactgggctgggcatttctttcagtctctccttggcactaggagccgaggaggggagcctcagaggttgcaagcactcgggaagctgggctgaggagcagggattctgtgctggagcttggacgtcagtacaggcctttgacaggcttcagaggtcctgccatcctccatgctctcagcatcccctcatccctctgatcaccgcccctgctgtttttcacccggtccccctcttgctgcgcagggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtttgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 429710 - DNA, 3398 bp, Homo sapiens
atcattgataggcgccgggcagctgagctggtaggaggaccagacggggatgttcggctccgcccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtttgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgaggaagctgaggcttggggatgttaaccagtttgcccagtccaaagtggtggagccgggaattgaatccacagttccctgaaattgagcccgcatcttctgtacaacagggaagatgaaaaagacaggtcctctggaggctttcagtaaacgtcggctggattctgtttacaaagctcagagtcaggatcttttatg

SEQ ID NO: 429711 - DNA, 2250 bp, Homo sapiens
atcattgataggcgccgggcagctgagctggtaggaggaccagacggggatgttcggctccgcccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaccagtcagcactatctttgaagaagacattgaagaagaaataaatattcttgataacagctctg

SEQ ID NO: 429712 - DNA, 1346 bp, Homo sapiens
atcattgataggcgccgggcagctgagctggtaggaggaccagacggggatgttcggctccgcccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccacctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 429713 - DNA, 1031 bp, Homo sapiens
  misc_feature (857)..(857): n is a, c, g, or t
  misc_feature (920)..(920): n is a, c, g, or t
  misc_feature (962)..(962): n is a, c, g, or t
aacttaggtcttaggtacgaggctgggtgttgtctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggancgagacctgacagtgggacaccggagctttttaattcagaagtgagccgggtaggaagcgcgnaagggtggggttgagtggaggccccggataagggctttaaangggccccggcccgtccggcggtaaaacctcggccccggggtcgcctaaacccgtcccccagatgcctag

SEQ ID NO: 429714 - DNA, 499 bp, Homo sapiens
  misc_feature (74)..(74): n is a, c, g, or t
  misc_feature (101)..(101): n is a, c, g, or t
tttagaattttatatgactccccatagaaaaattggccctcccggccaagaatttggctgggggaagaaaaggnaaataccccccccccttcccccaaatnttaagcacctgcgccagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429715 - DNA, 1730 bp, Homo sapiens
aaacgagagattttattttctcccaggtaggtagaccaaatctggcatggcagggacccattcttatgcagatgtgtcctgccatttttaaaactggctcccatcttgaggcgcagtttggcaattccagctcctgccctcctgtccgtattctagccagctggtcggggcaaggtagggaagctaaaggatcactccttccctttaatctagacgttgcacaaatccttgtccagaatataggcacatggccacacctcgccacagaggagactagttactgtgtatgaaggaaaaaataatcttggagggcacgtagcattctctgccacacttaggaaagaacaggctcctggggtttggagcagatcctcgatgtgtgaacaggaacctcttaaccctcatgtggggactccaaatacccttccaccatttgccctgttctttgcagtaacttggctcattttaggccttctaatgcggagactcagactccccacagcatctattggggtctagtgggcagataggcaagaggctgggattcattcacaacaaatttgttgagcatttaccttttgccagttcctgttttaggtactggggatacagtgatttacaagacaaagtccttattctcagggagcagaaaaacaataattgagaaacaaaaagagaatttcagatgttgatagatgttatgaagaaaataaaggaatgtgttagtgacttgagcaaggagcagtttttgatttagaagtcctcactgagcagaagacctttgatctaagacctgtcacaaagacagccacttttgtttcaatctggagaaagagctttccaagtggcgggaacagtaagcgcgaaaatcctgaggcaggattggattttgattgctagaggaacaaaagaaaggtgagtgtggctggagcttagagatcttgggaagggcggaaggagataaagccagaaaagcaggcaggggtcagatcaggtgaggtcttctgagccacagtaaagagtgtggattttctaagtgagacaggaagtctttggagggctttaagcaggagcaggaaagggggcagccacatgatctgatgtacttttccaaagatctctctggctgccatgtagacagacatggattgtaggattgccggggggaaaaaggagacgaggcaggcgctgttggtgacggctgaacaaaacatgtcagtggcatggtctagatgagagaaagaagagagcaagaagagtagatggatctggttatattaatgagccaggtgggaaagaggaggatggtgggatcctttgcactcttgagtcttctacccaagggcagagggctctgtcaaccctggacagtgagttttcaggcagcaaggaggcaactttatttaattcactgctggctgaatggaacctggtttctccctcatgagctttatgtgattttgatgggcaaagagtctcttctcagaatttacttgcccatcccttcattcatatattcatttattcagcaagcgcttggcatggtggcagaacgcgaaaggagcataagccataatcatgttttgcatttgtatggcgccttcaccctaggcaaaattatttcttctacattctttttctgcttctgcctccaggattttacagtctaattgaggagacaggacttgtacttttgaaacggtttagtttgtagaaaaaggcttggtata

SEQ ID NO: 429716 - DNA, 701 bp, Homo sapiens
aggaagggcctctcctgtggaaagggaaggatggcagagtcgtgagaaaggtgttgtcaagggaccaaaaatccttggctgttcagtcactgcggtcttgatccagccccagggggatgggcttcactggcagagctgggtactgctgtgcttttgccattaaaattctgttattaatgactcatcatcagtgccccagaggaagtgtgagaggacgagagggaggtggctcccatcagcagggccagcctgggtcaggatgctgggttaaagcccggcgccctcaccaatgagacctttgtgggaagctctactgcctcagtttccctatccggagatgctgttttcagggagtcctgacactatgatgggaacaaggctatttggtttactatatcattagtgctaatatagtgtggggcactcagatgttcagtaaatatacattcaacaaataagtgagtgattatactcaactccccccacccaatgcccagcaccaagcctacccagcacatagtaggtactttaagtaatttgaatgaataattttaaataacttgaatgaataattctgtattgccccccactcgccgcctatacacacgcacacacgcacacacacacacacggtttcctgtgctacttctggcacttagtaattattcaataaacacaaaatgtttgttgcaaaaaaaaat

SEQ ID NO: 429717 - DNA, 495 bp, Homo sapiens
gggtggcttcactgggggaatgggagttggtggaaggaggggttgtgcaagagatgctgggttaaagcccggcgccctcaccaatgagacctttgtgggaagctctactgcctcagtttccctatccggagatgctgttttcagggagtcctgacactatgatgggaacaaggctatttggtttactatatcattagtgctaatatagtgtggggcactcagatgttcagtaaatatacattcaacaaataagtgagtgattatactcaactccccccacccaatgcccagcaccaagcctacccagcacatagtaggtactttaagtaatttgaatgaataattttaaataacttgaatgaataattctgtattgccccccactcgccgcctatacacacgcacacacgcacacacacacacacggtttcctgtgctacttctggcacttagtaattattcaataaacacaaaatgtttgttgcaaaaaaaaat

SEQ ID NO: 429718 - DNA, 613 bp, Homo sapiens
aggaagggcctctcctgtggaaagggaaggatggcagagtcgtgagaaaggtgttgtcaagggaccaaaaatccttggctgttcagtcactgcggtcttgatccagccccagggggatgggcttcactggcagagctgggtactgctgtgcttttgccattaaaattctgttattaatgactcatcatcagtgccccagaggaagtgtgagaggacgagagggaggtggctcccatcagcagggccagcctgggtcaggatgctgggttaaagcccggcgccctcaccaatgagacctttgtgggaagctctactgcctcatgtttcccgagggagctcgagcaagttcactgctgccaacagctcacctccagggccttcccttctcctgtctttggttggcaggctggtgtcaaggttgaaggcatgggttttggtgttggcccagcctgggtccaaatcctggctctggctctactccctgcttgatcttgggaaagccacttgacctctccaagccccatatccgtgtctgtgaaatggggttaataatacctccctcccaggattgttggaaaatcaaattaaatcctattgtaaagcctgaaacctg

SEQ ID NO: 429719 - DNA, 3911 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggtattcccctgcccccaagcctgccttctgtgctgggctgctgagattgatgtctagaaatgagcagtgggcagggatgggggaaagtttggcttcttttctccacttggttctagcccagctgcgaaggaaaaataagaaagaagctcctaacttccaggaatttagactcaaaattcagggagggcagggattttgcctttcttctttgcaactacatcctcagcctagaatagcatcttgatgaatggattaattaatttttaaaaagtgggataagaacacaaagaggttatatataagaatgtatttcgtagagttgtatgtgaaggcaaaaaaacccaaaaaaacctgaaagtttcttcaatggaaaactggttaattacatctatttgggccttaaaatgatgtgctagatctgtatgtcagggaaagacattcatggtgtactattaaagttaaaaaaataggttataaagtagtatagagtgatctaagtctctctctctctctgcccccccccacacatatgtgcgtgcaaatgcgtagatgtctaaaaggtatgtgtgtgagtatgtctaacacatatatgtgagaagatatttgcaaggctgtacgctaaaattttaagcaagaatgatctttaggaggctgaatttcttgggattttatgtttctatttttggtttatatttttaaattttagcttatctgaattttctgactagtctataattattatgtattagttaattaaaataatttttaaaaatttcactgagtgcaaaagatgcttacagagttgccagccgactgggtgtttctccctttgccccagcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429720 - DNA, 3636 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcaggtacagacccaagtccaagccaacaggttcattccctgagctcagtactctgtgacagataagtaggtagcagtagtctctggtctcctagtcatttccaaccccagtggtggctaagaatgcagcttttgtgctgggattacaagtgtgagccaccgcgcccagtcaaacctgagttttaacccccactatcactgaacttggactccatggcttagtgcctcagtttcttcacctctgaaaatgaaggtaatggtagcacctaactcattaagttgtcataaggatgaaatgagatgacactaagggacttagcacagcctgacagcacagtaggtattgaacaaatggtagctgctctgatgattttgtaggagagacaatatcccaaggttgcctgaattacccttctagggctctaagagccctgctcactcatgagtcactggggttgggagttaacaatgcctggggaaccaagcccttgaagaagtgctggctccaaagtaggagtccaagaatatacagcaagagtaagagttgctctcacctcttcttgtagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429721 - DNA, 3089 bp, Homo sapiens
acccaccatccctcaccacccaccccaccaatcagcacagaaatccctcggtataaacggcacgagggctctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429722 - DNA, 3052 bp, Homo sapiens
aacttaggtcttaggtacgaggctgggtgttgtctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429723 - DNA, 2329 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429724 - DNA, 3893 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaaccttgagtattatgggaagagccagggagacgggcagggggagctgaaagctgaggctccgtcctcatctctaaactctccactaaccaatttaaaggatcttaaaagcttctccaggagagagacttaggaaaaaaaaagatttctgagtcagtgctaatgagtccagttactgaatttgtgaatagctattccctggcttctggatgttagcccaagttgaatagcatagatgtggttgagagtggggtctgggagggatagagagcccaccgcccaccccccacaatcccatgactgagtggagaccaaccagcctggccaattcaaaggcaagaagatttgaggggggaaagttgtccacgtttccctctctgcttcccaccccatctctctcaacttcttagtggtcctgccatactttcctagcacctctctttcacccggggagcccaagcgtcctctagctccatctcctcgcctgctccctgcctccttttcagggctgccctgcacactggctcaccactgttggaccctgcacatggccaccttccacagatggcactccttgggagcagggtccttgtctttgtattccagtgtccccagcactgagtgcaaggccccatgcagggtaggaaacctgaggtttcaagctcagggttttaagctgtgcagtgcactaagctctctgccaaaaaacaaacaaaaaaaggtttctgtggttaaataagtttgggaaatgctgcaccagacgtcccctttttatagattcacaatacacatcagcatatttgaggttccaagaagtcctcca

SEQ ID NO: 429725 - DNA, 3202 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaacttgatcttgggaaagccacttgacctctccaagccccatatccgtgtctgtgaaatggggttaataatacctccctcccaggattgttggaaaatcaaattaaatcctattgtaaagcctgaaacctg

SEQ ID NO: 429726 - DNA, 3015 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggtattcccctgcccccaagcctgccttctgtgctgggctgctgagattgatgtctagaaatgagcagtgggcagggatgggggaaagtttggcttcttttctccacttggttctagcccagctgcgaaggaaaaataagaaagaagctcctaacttccaggaatttagactcaaaattcagggagggcagggattttgcctttcttctttgcaactacatcctcagcctagaatagcatcttgatgaatggattaattaatttttaaaaagtgggataagaacacaaagaggttatatataagaatgtatttcgtagagttgtatgtgaaggcaaaaaaacccaaaaaaacctgaaagtttcttcaatggaaaactggttaattacatctatttgggccttaaaatgatgtgctagatctgtatgtcagggaaagacattcatggtgtactattaaagttaaaaaaataggttataaagtagtatagagtgatctaagtctctctctctctctgcccccccccacacatatgtgcgtgcaaatgcgtagatgtctaaaaggtatgtgtgtgagtatgtctaacacatatatgtgagaagatatttgcaaggctgtacgctaaaattttaagcaagaatgatctttaggaggctgaatttcttgggattttatgtttctatttttggtttatatttttaaattttagcttatctgaattttctgactagtctataattattatgtattagttaattaaaataatttttaaaaatttcactgagtgcaaaagatgcttacagagttgccagccgactgggtgtttctccctttgccccagcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggtatgcgatctcagtggacaagcatgttggggatgaagcctgataagagaagggattttggaactggtactgagttcttctgtgcttaggagattgttggataggagccttggcctggcttcaagccttagcgctcactgacttactgtgtgaccgttgggcagttgcagtagtacgccagagctggcttgcaccaggctgtgagagctgttggcagcttaaaatctgctatggtgggaatatttgcaccacagaaattgctaaatgccataaaacagggctttttccctcctcgagagccagttgttcaacatttaccagcacactactgggcctggtcacttcttgattcaaacctgtttcctcgtctttaaaatcagaataataatgcttgccttacctgtccagtacttcacagggtggttgtgaggatcaaaatctaactgagataactaacaggtgtgacagtgctgtgaaacctgtacacatgaaaaacacatcattacaagtgatggtaacccagggaaattagaagacgcatcaagtggagacagtaaacagggaacactgctcagtttggggtgggtggggatgtctggttgtctgtgaactggggtcattggcattcagacaattcagatgtgttccatgaagcattagttctctgggatgcttgtaagtcataagaggaaaaaaatggttagatgggtttgggaaatactgagttaaacagttaatataggaagtctcaaagctttatgtcactgtagatcactgaaaaggccatctgtaatttgctgtattcctcaagtgtatttgaccagtatatcttttgagttgcatcttgaaggaccaggagtcttggattaaatcaagcaatatatgcgtgaactgtaatctccctaca

SEQ ID NO: 429727 - DNA, 2364 bp, Homo sapiens
gttgggcagactggtctccaactcatgacctcgtgatctgcccaccttgccctcccaaagtgctgggattacaggtgtgagccaccgcgcccaggccaagcatagctttttaaaggagaagagtttccttttctgtcagccctcccaggcagagattcaggaaggcacagggcctttgggaagacaaccctccaccttcgcctccttgctgtttcagggcaacataggagcccgactcccaggtttgctataactggcctgagtgtttcctgtagccttcgttgtgcatgctttcagccagcctatgcaagagaagcctccacactgccctggctggaatctccctgggtggagggatccccctctcctttgtgttgggtgagctctgagcctctggcatttcgtagttgagatcccttgctatggggcgggccaggactgggccttgaccgtgtgtggatgaagtcccagcatgcctgacttcatcttcctcctcccttagcatgtcagttcctcattcctgcatgtgtgtatctgtttgtctgtccattttctccttaggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429728 - DNA, 1898 bp, Homo sapiens
  misc_feature (45)..(45): n is a, c, g, or t
gagggattcggcacgaatcccttgtgaagcaagctgcaaaactangcttgaaaaatgcccaagctttccctcgggggcttttcaacaaagaacccgactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429729 - DNA, 2926 bp, Homo sapiens
gttgggcagactggtctccaactcatgacctcgtgatctgcccaccttgccctcccaaagtgctgggattacaggtgtgagccaccgcgcccaggccaagcatagctttttaaaggagaagagtttccttttctgtcagccctcccaggcagagattcaggaaggcacagggcctttgggaagacaaccctccaccttcgcctccttgctgtttcagggcaacataggagcccgactcccaggtttgctataactggcctgagtgtttcctgtagccttcgttgtgcatgctttcagccagcctatgcaagagaagcctccacactgccctggctggaatctccctgggtggagggatccccctctcctttgtgttgggtgagctctgagcctctggcatttcgtagttgagatcccttgctatggggcgggccaggactgggccttgaccgtgtgtggatgaagtcccagcatgcctgacttcatcttcctcctcccttagcatgtcagttcctcattcctgcatgtgtgtatctgtttgtctgtccattttctccttaggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcaggtacagacccaagtccaagccaacaggttcattccctgagctcagtactctgtgacagataagtaggtagcagtagtctctggtctcctagtcatttccaaccccagtggtggctaagaatgcagcttttgtgctgggattacaagtgtgagccaccgcgcccagtcaaacctgagttttaacccccactatcactgaacttggactccatggcttagtgcctcagtttcttcacctctgaaaatgaaggtaatggtagcacctaactcattaagttgtcataaggatgaaatgagatgacactaagggacttagcacagcctgacagcacagtaggtattgaacaaatggtagctgctctgatgattttgtaggagagacaatatcccaaggttgcctgaattacccttctagggctctaagagccctgctcactcatgagtcactggggttgggagttaacaatgcctggggaaccaagcccttgaagaagtgctggctccaaagtaggagtccaagaatatacagcaagagtaagagttgctctcacctcttcttgtagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429730 - DNA, 2514 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggtattcccctgcccccaagcctgccttctgtgctgggctgctgagattgatgtctagaaatgagcagtgggcagggatgggggaaagtttggcttcttttctccacttggttctagcccagctgcgaaggaaaaataagaaagaagctcctaacttccaggaatttagactcaaaattcagggagggcagggattttgcctttcttctttgcaactacatcctcagcctagaatagcatcttgatgaatggattaattaatttttaaaaagtgggataagaacacaaagaggttatatataagaatgtatttcgtagagttgtatgtgaaggcaaaaaaacccaaaaaaacctgaaagtttcttcaatggaaaactggttaattacatctatttgggccttaaaatgatgtgctagatctgtatgtcagggaaagacattcatggtgtactattaaagttaaaaaaataggttataaagtagtatagagtgatctaagtctctctctctctctgcccccccccacacatatgtgcgtgcaaatgcgtagatgtctaaaaggtatgtgtgtgagtatgtctaacacatatatgtgagaagatatttgcaaggctgtacgctaaaattttaagcaagaatgatctttaggaggctgaatttcttgggattttatgtttctatttttggtttatatttttaaattttagcttatctgaattttctgactagtctataattattatgtattagttaattaaaataatttttaaaaatttcactgagtgcaaaagatgcttacagagttgccagccgactgggtgtttctccctttgccccacacagaaattgctaaatgccataaaacagggctttttccctcctcgagagccagttgttcaacatttaccagcacactactgggcctggtcacttcttgattcaaacctgtttcctcgtctttaaaatcagaataataatgcttgccttacctgtccagtacttcacagggtggttgtgaggatcaaaatctaactgagataactaacaggtgtgacagtgctgtgaaacctgtacacatgaaaaacacatcattacaagtgatggtaacccagggaaattagaagacgcatcaagtggagacagtaaacagggaacactgctcagtttggggtgggtggggatgtctggttgtctgtgaactggggtcattggcattcagacaattcagatgtgttccatgaagcattagttctctgggatgcttgtaagtcataagaggaaaaaaatggttagatgggtttgggaaatactgagttaaacagttaatataggaagtctcaaagctttatgtcactgtagatcactgaaaaggccatctgtaatttgctgtattcctcaagtgtatttgaccagtatatcttttgagttgcatcttgaaggaccaggagtcttggattaaatcaagcaatatatgcgtgaactgtaatctccctaca

SEQ ID NO: 429731 - DNA, 1631 bp, Homo sapiens
  misc_feature (35)..(35): n is a, c, g, or t
gggggggggcggggtgggggggagggggcgtgccntcgctgcaggctggggagggccacagcctggctcagtaccgctatgccaggtgcctactacgagacccagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagacaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429732 - DNA, 2358 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcaggtacagacccaagtccaagccaacaggttcattccctgagctcagtactctgtgacagataagtaggtagcagtagtctctggtctcctagtcatttccaaccccagtggtggctaagaatgcagcttttgtgctgggattacaagtgtgagccaccgcgcccagtcaaacctgagttttaacccccactatcactgaacttggactccatggcttagtgcctcagtttcttcacctctgaaaatgaaggtaatggtagcacctaactcattaagttgtcataaggatgaaatgagatgacactaagggacttagcacagcctgacagcacagtaggtattgaacaaatggtagctgctctgatgattttgtaggagagacaatatcccaaggttgcctgaattacccttctagggctctaagagccctgctcactcatgagtcactggggttgggagttaacaatgcctggggaaccaagcccttgaagaagtgctggctccaaagtaggagtccaagaatatacagcaagagtaagagttgctctcacctcttcttgtagccccggggcccagcgacctgacagttacaggactgaagtctttctccagcccctccctctgcagcttgaacaccctgctagcaggaacctcacgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429733 - DNA, 623 bp, Homo sapiens
tcgagctcggtccaggctcctctttaggctgaggtgagaagttctgaaagtcagcagacacatccaggaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429734 - DNA, 571 bp, Homo sapiens
gctcggtacccgtcgtgctggcctcgaactcctgacctcaggtgatccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429735 - DNA, 1053 bp, Homo sapiens
  misc_feature (879)..(879): n is a, c, g, or t
  misc_feature (942)..(942): n is a, c, g, or t
  misc_feature (984)..(984): n is a, c, g, or t
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggancgagacctgacagtgggacaccggagctttttaattcagaagtgagccgggtaggaagcgcgnaagggtggggttgagtggaggccccggataagggctttaaangggccccggcccgtccggcggtaaaacctcggccccggggtcgcctaaacccgtcccccagatgcctag

SEQ ID NO: 429736 - DNA, 3074 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429737 - DNA, 483 bp, Homo sapiens
gcctgaacctgcaatgacagaggaaggtttacccgcaaatggggttgggaaagatgacatccgcacttgaagagctacttgttgggaaagaacgggtctgcatcagttcagatccaagttccttttgccttgtgcttgggaatgtagagaggtgcgggcctggatggctttggaaatgttcctttcaacagtgtttcccgagggagctcgagcaagttcactgctgccaacagctcacctccagggccttcccttctcctgtctttggttggcaggctggtgtcaaggttgaaggcatgggttttggtgttggcccagcctgggtccaaatcctggctctggctctactccctgcttgatcttgggaaagccacttgacctctccaagccccatatccgtgtctgtgaaatggggttaataatacctccctcccaggattgttggaaaatcaaattaaatcctattgtaaagcctgaaacctg

SEQ ID NO: 429738 - DNA, 3021 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagacaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429739 - DNA, 3312 bp, Homo sapiens
gggagcagattgccgtcatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacatcagggagggtggccttgaactgcttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429740 - DNA, 2207 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgt

SEQ ID NO: 429741 - DNA, 3678 bp, Homo sapiens
  misc_feature (3678)..(3678): n is a, c, g, or t
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaacaaaaaaaaaaaaaaaaaaaaaaaaaaaaaaaaaaaagaagagaaaagacaagaaaagaaaaaaaaagaagaaaaaaaaaaaagaagagagcgagaagaagagagagagagagaggacaacaagaaaagtatagagaagagcaccacgggccgccgcaacgcggcgcgcgcgcccagccaggagagaaccgagggagagaagagagataaaaggagacgagaggaaacaacaacacaacaaaaagaagaagagcacgacgaagaagaggagagaagaagcagcaacagtacacgaacaaaagaacaacaaaaacagagagaggggataacaggagcgcaaatctaacagagcggagagaaaaccgagccgagagagaggagacacaaatcgaggagcatcacgaacagaagcaaagaataagtatacagaagacgccgacgagatcacaggcgacgaacaagaggccaacagaaagaaagaaagaaaaccaacagggacaacaaagacagaagcagagagagagagaaaaaaaaaaataaggagataagaaaaacacaacgcgaccgcaaccgccggacaagacgaaagcgataacgcaaaactn

SEQ ID NO: 429742 - DNA, 3689 bp, Homo sapiens
cacaacagggtgtttttggctggaagcctctcatgggctcagacttggagaggcatggatagaatccaaagacagaagcccccacgggggtgggggtggggcctcatctgtggaagggggtggtcgactttccaggagttttccagctccacattcccatgtatttcagggaagccattctgaagcgggaggtggtacagcacagagtttatgcagtcaggctctgggggacggccttccggtcacttccaggaaccaatgtgtcttcatctatcgactgaggatatgcgtggcccctgatctccctgctctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggtattcccctgcccccaagcctgccttctgtgctgggctgctgagattgatgtctagaaatgagcagtgggcagggatgggggaaagtttggcttcttttctccacttggttctagcccagctgcgaaggaaaaataagaaagaagctcctaacttccaggaatttagactcaaaattcagggagggcagggattttgcctttcttctttgcaactacatcctcagcctagaatagcatcttgatgaatggattaattaatttttaaaaagtgggataagaacacaaagaggttatatataagaatgtatttcgtagagttgtatgtgaaggcaaaaaaacccaaaaaaacctgaaagtttcttcaatggaaaactggttaattacatctatttgggccttaaaatgatgtgctagatctgtatgtcagggaaagacattcatggtgtactattaaagttaaaaaaataggttataaagtagtatagagtgatctaagtctctctctctctctgcccccccccacacatatgtgcgtgcaaatgcgtagatgtctaaaaggtatgtgtgtgagtatgtctaacacatatatgtgagaagatatttgcaaggctgtacgctaaaattttaagcaagaatgatctttaggaggctgaatttcttgggattttatgtttctatttttggtttatatttttaaattttagcttatctgaattttctgactagtctataattattatgtattagttaattaaaataatttttaaaaatttcactgagtgcaaaagatgcttacagagttgccagccgactgggtgtttctccctttgccccagcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429743 - DNA, 2178 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggtatgcgatctcagtggacaagcatgttggggatgaagcctgataagagaagggattttggaactggtactgagttcttctgtgcttaggagattgttggataggagccttggcctggcttcaagccttagcgctcactgacttactgtgtgaccgttgggcagttgcagtagtacgccagagctggcttgcaccaggctgtgagagctgttggcagcttaaaatctgctatggtgggaatatttgcaccacagaaattgctaaatgccataaaacagggctttttccctcctcgagagccagttgttcaacatttaccagcacactactgggcctggtcacttcttgattcaaacctgtttcctcgtctttaaaatcagaataataatgcttgccttacctgtccagtacttcacagggtggttgtgaggatcaaaatctaactgagataactaacaggtgtgacagtgctgtgaaacctgtacacatgaaaaacacatcattacaagtgatggtaacccagggaaattagaagacgcatcaagtggagacagtaaacagggaacactgctcagtttggggtgggtggggatgtctggttgtctgtgaactggggtcattggcattcagacaattcagatgtgttccatgaagcattagttctctgggatgcttgtaagtcataagaggaaaaaaatggttagatgggtttgggaaatactgagttaaacagttaatataggaagtctcaaagctttatgtcactgtagatcactgaaaaggccatctgtaatttgctgtattcctcaagtgtatttgaccagtatatcttttgagttgcatcttgaaggaccaggagtcttggattaaatcaagcaatatatgcgtgaactgtaatctccctaca

SEQ ID NO: 429744 - DNA, 2872 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggtattcccctgcccccaagcctgccttctgtgctgggctgctgagattgatgtctagaaatgagcagtgggcagggatgggggaaagtttggcttcttttctccacttggttctagcccagctgcgaaggaaaaataagaaagaagctcctaacttccaggaatttagactcaaaattcagggagggcagggattttgcctttcttctttgcaactacatcctcagcctagaatagcatcttgatgaatggattaattaatttttaaaaagtgggataagaacacaaagaggttatatataagaatgtatttcgtagagttgtatgtgaaggcaaaaaaacccaaaaaaacctgaaagtttcttcaatggaaaactggttaattacatctatttgggccttaaaatgatgtgctagatctgtatgtcagggaaagacattcatggtgtactattaaagttaaaaaaataggttataaagtagtatagagtgatctaagtctctctctctctctgcccccccccacacatatgtgcgtgcaaatgcgtagatgtctaaaaggtatgtgtgtgagtatgtctaacacatatatgtgagaagatatttgcaaggctgtacgctaaaattttaagcaagaatgatctttaggaggctgaatttcttgggattttatgtttctatttttggtttatatttttaaattttagcttatctgaattttctgactagtctataattattatgtattagttaattaaaataatttttaaaaatttcactgagtgcaaaagatgcttacagagttgccagccgactgggtgtttctccctttgccccagcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggtatgcgatctcagtggacaagcatgttggggatgaagcctgataagagaagggattttggaactggtactgagttcttctgtgcttaggagattgttggataggagccttggcctggcttcaagccttagcgctcactgacttactgtgtgaccgttgggcagttgcagtagtacgccagagctggcttgcaccaggctgtgagagctgttggcagcttaaaatctgctatggtgggaatatttgcaccacagaaattgctaaatgccataaaacagggctttttccctcctcgagagccagttgttcaacatttaccagcacactactgggcctggtcacttcttgattcaaacctgtttcctcgtctttaaaatcagaataataatgcttgccttacctgtccagtacttcacagggtggttgtgaggatcaaaatctaactgagataactaacaggtgtgacagtgctgtgaaacctgtacacatgaaaaacacatcattacaagtgatggtaacccagggaaattagaagacgcatcaagtggagacagtaaacagggaacactgctcagtttggggtgggtggggatgtctggttgtctgtgaactggggtcattggcattcagatctgtaatatgtgtaacatttgatattaatttttgtggtttttcttgtaaagttatatgagggatatttattggttaataggggttttgtgatatacattttttttatctttttatttatagtagttctctaa

SEQ ID NO: 429745 - DNA, 1143 bp, Homo sapiens
  misc_feature (31)..(31): n is a, c, g, or t
  misc_feature (61)..(61): n is a, c, g, or t
  misc_feature (63)..(63): n is a, c, g, or t
  misc_feature (73)..(73): n is a, c, g, or t
  misc_feature (75)..(76): n is a, c, g, or t
  misc_feature (84)..(84): n is a, c, g, or t
agcgaaataagttaaaagccaacttctcggngtttcacaagacctactggtgagaaaggtntnaatatctttntnnaccacaanggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcaaaaaaaaaaac

SEQ ID NO: 429746 - DNA, 1618 bp, Homo sapiens
gggtggtcggtgtgcttgtgaccctgcctttgtgtggctgtcaccggtgggactggcggggagctgtgtgattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429747 - DNA, 2177 bp, Homo sapiens
  misc_feature (75)..(75): n is a, c, g, or t
  misc_feature (1539)..(1540): n is a, c, g, or t
  misc_feature (1598)..(1598): n is a, c, g, or t
  misc_feature (2014)..(2014): n is a, c, g, or t
  misc_feature (2023)..(2023): n is a, c, g, or t
  misc_feature (2032)..(2032): n is a, c, g, or t
cctttgagcagtaggaattggcttgctgcccatgggcacctggctggagtaggcagtgtaggctgagggctgtanaaggccgggtttcattggtttgtacccaggtttccagaatagaaaaatgccacaacctcctgagaagcccagttcatggtctctcacctaagttgtggttcctcactgatgacttttctggccccaccacagatgataccacctttataagcacaaatgttgtctgtggatttaatgtaaatgtgaaaaacaaaattatttcaaaaactttacctgtgtttcttcctgcagctagaaagtttgggtcagagtgaactggcttcaagacttaccttgaattgtcaaaattcttatgtggaacctcataaaattcgggacatacctgtaactattatggatgtaagcttccttttaagtaaaatagctgctttactttttaaaatgtgtatgtcaagatctcctataaaactatttgataactttcaatgtgcctcttcaaatgctgccttggcttttgtttttaccctccagctttctcaattccaaaataatctgtttattgcttatcttggatttctttctggcaggaataacaccattgaaatcaaaataggccgagcacagtggcttatgcctgtaatcccagcgctttgggaggctgaggcaggaggattgcttgagtccaagagttcaggaccagcctgggcaacatagtgagaccctgtctgtatttatttaaaaaaaataaaaataaaaatgaatcaaaataaatttaaacaagggagtctacccatttgatgtatttttgctgttctcatcaatagatattgcaccatatattgcacatatatgggcagcaaagagaaggtgcttcacaagggtaacaagggtagagaatcaagaattccatagtttaattaccacaaaagcttgcttatttttttattgtggtaaaatgtacatttaaaatatgccattttaaccatttttaagtgcatagttcagtggcattaagtatattcacagttcggcaaccatcaccattttcacaacattttcatcattccaagaagaaattgcatacccattaaacaataactcctgttccctttcttcccccggcctctgataatcaacggttttattttctgtctataaaaatttacctattctagaacctcatataagtagaatcatacaacatttatccttttgtgtggccatttcacttagcataatgtttcacaagacttatcttgaaatgttatacatgtgtcagaatgtcatttctttcttttttttttttttttttttggaaacagggtctcactctgttccccaggctggagtgcagtggtgcaatctcagctcactgcaacctctgcctcccgggcccaaacaatcctccctcctcagcctccttagtagcttggaccacaggctcacaccactacgttcggctaattttttgtagagatggggtttcaccatgttgcccatgctggactcaaactctgggactcnngctgtctgcctgcctgggcctcccaaagtgctatgacaggcatgagccaccacgcccngcctatttctttttaaagctgaataatatctaccaataaaaccaatgttggtttataccacattttgtttatccattcatccgtcagtggtcacttgggttgtgttcagcttttggcaattgtgaatagtgcttctatgaacattggtgtaaaagtatatgtttgggcagggcacagtggctcattcctgcaatcccagcactttgggaggctgactcaagaggattgcttgagcccaggaattcgagaccagtctgggcaatacaggagaccctgtctctactactaataaagaaaattaggccgggcgcggtggctcacccctgtaatcccagaactttgggaggccaaggcgggtggatcatgaggtcaagagatcgagaccatcctggccaacgtggtgaaacccgtctctnctgaaaatncaaaaattngccgggcatggtggcacacacctgtactcccagctattcgggaggctgaggcaggagaattgcttgaatctgggcggtggaggttgcagtgagctgagatcgcaccactgcattccagcctgccaatagagtgagacttcgtctc

SEQ ID NO: 429748 - DNA, 402 bp, Homo sapiens
tcccccgggctgcaggattcggcacgagcttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429749 - DNA, 537 bp, Homo sapiens
  misc_feature (148)..(148): n is a, c, g, or t
gccggtgtcgtgttgggtgggaagacccccctgtcctaggggtgtttttcctatcattaacaaatcccgggtggtgcgtatcccagcctcgtggattttatggttagcctccgcgtaggaaaaaaaattttaccaccagggaacaacntaatgcccatgtggggccttttagggtgctcatataaaaacagttttgcacaaaaaaaacagtggggttccccgtttcggaattccgggaatatctttcgacccagggggtccgttcgcgagcggccccccccttttttttttttttttttttttttttttatcaaagtggtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429750 - DNA, 1114 bp, Homo sapiens
cggtatcccgtagtctcgatcaaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429751 - DNA, 1270 bp, Homo sapiens
  misc_feature (75)..(75): n is a, c, g, or t
cctttgagcagtaggaattggcttgctgcccatgggcacctggctggagtaggcagtgtaggctgagggctgtanaaggccgggtttcattggtttgtacccaggtttccagaatagaaaaatgccacaacctcctgagaagcccagttcatggtctctcacctaagttgtggttcctcactgatgacttttctggccccaccacagatgataccacctttataagcacaaatgttgtctgtggatttaatgtaaatgtgaaaaacaaaattatttcaaaaactttacctgtgtttcttcctgcagctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429752 - DNA, 1757 bp, Homo sapiens
agcgggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggtgctagaaagttgggtcagagtgaaactggcttttcccaaaaaaatgggaaaaaacccatttttaaaaacccccttttggaaaacttggtccaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429753 - DNA, 886 bp, Homo sapiens
ggattactaaatggctgttaccaatggctggtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429754 - DNA, 1005 bp, Homo sapiens
tcaaggaaacagatttacggccattgacccatcaatggtcatgccgagtgagcttgaggtgcagaaaggcagccttgcatcagccaggaggagcagtattgtgcctctcgctgtcaatgatgagttgacccggtgtgtcatgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttcccatggatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429755 - DNA, 716 bp, Homo sapiens
attggctacggattctggattctgcagccttgtaggtcatagcatctatcatgtgtcaaatgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429756 - DNA, 1175 bp, Homo sapiens
agcgggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacaggtaaggcctagcttgaaacccagagcactctgagccccacatatgtttgcaacataaagacttctctccatggactagttagggaatcagtgaactacagaattccttgtagaaatgaggcattgacttgataaaagtggtgttacatttataacttgtagataccatttgaa

SEQ ID NO: 429757 - DNA, 1717 bp, Homo sapiens
agcgggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429758 - DNA, 1636 bp, Homo sapiens
agcgggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctgttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429759 - DNA, 1664 bp, Homo sapiens
agcgggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429760 - DNA, 1609 bp, Homo sapiens
agcgggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacagggtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429761 - DNA, 1663 bp, Homo sapiens
agcgggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctacctttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 429762 - DNA, 1176 bp, Homo sapiens
agcgggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggggtaaggatcatgacattgggttggggacacattgtattgggaattttcacatctacttggttccagaagatagatctgtctcacaagtatgtgtaagaggtatttgctaagcagagtaatacatctgagcagatattattgctggtaagggcttgcctacattagtgcttcccaccagctattcatcaaaatcacttaggggagctttcaaaaatacagattgtaaggcctcacagcagatcatccatctggaatccctgggcatgggatctgggaatctatttttacttcacacttttcctctacccaccaggtaaatctgatgaaccaggtctgttggcttgcatttaggaactgctgggctagatgatttctcaaatctcttttaagatcccttaaaggtttatcttaaaaaaaaaaaa

SEQ ID NO: 429763 - DNA, 843 bp, Homo sapiens
tagggtcttagggagaaaaccaaggaagatattagaaaagttacacacaagctgttggtttagtatgaaaaacttttgattctatctgctacttagaatttatcacaattaaccaatcctttcagtaaattatctgtttgccactgtgtatatggacatatcgtggctaaatacatttaagagagagaagaaaaattcctattaagaacttttaacactggaattacctgagtttcacttacctggaatattttttgtgtggcataaattggcaacagaggtcaggacagttggacgcaaatgccccgggccctatgtgatgagtctcctgcagccaggtcctgtgttcccaagtgggaacagtgagaacagtgacctcactgtactcccaaatcacatttgttctaaaattttatccttctctacttttgccaatcactacttttcttgtcttttgcagatatgttatgctattaatttgggaaaagaaattattgaggttcagaaggtaagatgcattctagcgctggtttagtagctactcaaaacacatctgtgtacacataccaagagtcttttcaaaaagaaaagtgatgttcactggaaagtgtggccaagtttgggatttccttttaaaagtattctaaccaccagaggtttttgatcagctagttccatgttcactgttaacacatgaggacttcttatcactgctggagctcctgcttatctgttttcttgcttgcatactagttggctagatttcctttctttcagattaagatgatagataagtacccaccgtgtgctgctctaaggccttgctcctcagagtaggatcac

SEQ ID NO: 429764 - DNA, 3230 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgatggaaaatatgtactgttaaacgatcaaccagatgacgatgatggaaatccaaatgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcacaattggacctaatagcatttctttgtgcagttaggtgacgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429765 - DNA, 3295 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcagttcaagtgttaagtgcccttctagctgcagctgtcgtgtttgttcaactctggctattcccctaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgatggaaaatatgtactgttaaacgatcaaccagatgacgatgatggaaatccaaatgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcacaattggacctaatagcatttctttgtgcagttaggtgacgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429766 - DNA, 3391 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcagggctgagagaggttatctctgggagaactgaaagtaaatttgaggtatcttgtgtccccctccaccaccaaagactgttgccattctgatttccagttcaagtgttaagtgcccttctagctgcagctgtcgtgtttgttcaactctggctattcccctaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgatggaaaatatgtactgttaaacgatcaaccagatgacgatgatggaaatccaaatgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcacaattggacctaatagcatttctttgtgcagttaggtgacgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429767 - DNA, 3248 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagcagaagataagcactttacaaggatcctatatggacctcgctagcaatgagcaatgacctctccaatggcaaactacagcaaggctgacctacagaaacacggggagcaatgagcacgcgtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgatggaaaatatgtactgttaaacgatcaaccagatgacgatgatggaaatccaaatgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcacaattggacctaatagcatttctttgtgcagttaggtgacgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429768 - DNA, 2787 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccaggctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgatggaaaatatgtactgttaaacgatcaaccagatgacgatgatggaaatccaaatgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcacaattggacctaatagcatttctttgtgcagttaggtgacgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429769 - DNA, 3242 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcagttcaagtgttaagtgcccttctagctgcagctgtcgtgtttgttcaactctggctattcccctaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgatggaaaatataggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcacaattggacctaatagcatttctttgtgcagttaggtgacgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429770 - DNA, 1660 bp, Homo sapiens
tagggtcttagggagaaaaccaaggaagatattagaaaagttacacacaagctgttggtttagtatgaaaaacttttgattctatctgctacttagaatttatcacaattaaccaatcctttcagtaaattatctgtttgccactgtgtatatggacatatcgtggctaaatacatttaagagagagaagaaaaattcctattaagaacttttaacactggaattacctgagtttcacttacctggaatattttttgtgtggcataaattggcaacagaggtcaggacagttggacgcaaatgccccgggccctatgtgatgagtctcctgcagccaggtcctgtgttcccaagtgggaacagtgagaacagtgacctcactgtactcccaaatcacatttgttctaaaattttatccttctctacttttgccaatcactacttttcttgtcttttgcagatatgttatgctattaatttgggaaaagaaattattgaggttcagaaggatccagaagcactggctcaattaatgctgtccataccactaaccaatgatggaaaatatgtactgttaaacgatcaaccagatgacgatgatggaaatccaaatgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcacaattggacctaatagcatttctttgtgcagttaggtgacgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429771 - DNA, 751 bp, Homo sapiens
cttctaaaactaggtgctattgacttctaaaactgggtgctattgaaacttctaaaactaggcctagggttttaaaaaatggcaaaagcctagatttacaatttgatgaacactaaatatttcttattaatataatctatttttgtattttacttaatgagctttaagtgcctgtcgttctgaaaattgtgtatttataattcagcttatctcacaattggacctaatagcatttctttgtgcagttaggtgacgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429772 - DNA, 1482 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429773 - DNA, 2925 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcagggctgagagaggttatctctgggagaactgaaagtaaatttgaggtatcttgtgtccccctccaccaccaaagactgttgccattctgatttccagttcaagtgttaagtgcccttctagctgcagctgtcgtgtttgttcaactctggctattcccctaggcgtaccaacccttttggtgaaactgaggatgaatcatttccagaagcagaaggtaagtgactagtttggtgtccttattctttcctctgcacaaaatgacaacggccattgaaataagatgtgaaatcatgttttagagagctatgattaggagtatgaattaagatttgttgttctgaaagtttagtaagatatctgcagtggaggcaagtcttggataaaaactgaggggtagctgaaagaccacctacagctatttcaccattagccatagcgtttttgtagcatagcatagaaatgttgtgaaatctgaatctgttatcacattcaaatgcagtcttggtgaactggaaatatgctgtgtcattttagaaaaccaaaagcacaaataacttgttcttgaatttgaagatgacacaaatgatatttaagtctttcaaattcaaatttttggttttttacattcttataatgtacttaagaacgtatctgatggccggcacgctggctcacgcctgtaatcccagcacttttggaggccgaggcaggtgaatcacgtgagcttaggagttcaagaccagcatgggcaacacagtgagaaccctgtctctacaaaaatatatatatatatacaaaaattagccaggtgtagtgacaggtgcctgtaatcctagctactcaggaggctgagacatgagaatcacttgaacctgggaggcggaggttgcagtgagctgaaatcatgccattgcactccagcctgggctacagagtgagaccctgtctcaaaaaagaaaaaaaagaaaaaaccttctttggtcttctagttatggttgctgggagtcagttttgtcaagttatgcgccactgtcagcagccaggactgacttcctttaggctatgaaacatcatcactgcctttccgtaatacacatgaagtatgaattgcatgagacccaacatgagatcttatatcctgcaaataaaatttcttttctaagaggactttatcagtgggccaaagtaatgaattttctattgtctagtgaactcactcttttcagagaaaaggtacaatgtagtcacctagagtttcagcattagaaggatgttcatctggtaccaccatcatttcattt

SEQ ID NO: 429774 - DNA, 2806 bp, Homo sapiens
  misc_feature (2735)..(2735): n is a, c, g, or t
  misc_feature (2760)..(2760): n is a, c, g, or t
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcagggctgagagaggttatctctgggagaactgaaagtaaatttgaggtatcttgtgtccccctccaccaccaaagactgttgccattctgatttccagttcaagtgttaagtgcccttctagctgcagctgtcgtgtttgttcaactctggctattcccctaggcgtaccaacccttttggtgaaactgaggatgaatcatttccagaagcagaaggtaagtgactagtttggtgtccttattctttcctctgcacaaaatgacaacggccattgaaataagatgtgaaatcatgttttagagagctatgattaggagtatgaattaagatttgttgttctgaaagtttagtaagatatctgcagtggaggcaagtcttggataaaaactgaggggtagctgaaagaccacctacagctatttcaccattagccatagcgtttttgtagcatagcatagaaatgttgtgaaatctgaatctgttatcacattcaaatgcagtcttggtgaactggaaatatgctgtgtcattttagaaaaccaaaagcacaaataacttgttcttgaatttgaagatgacacaaatgatatttaagtctttcaaattcaaatttttggttttttacattcttataatgtacttaagaacgtatctgatggccggcacgctggctcacgcctgtaatcccagcacttttggaggccgaggcaggtgaatcacgtgagcttaggagttcaagaccagcatgggcaacacagtgagaaccctgtctctacaaaaatatatatatatatacaaaaattagccaggtgtagtgacaggtgcctgtaatcctagctactcaggaggctgagacatgagaatcacttgaacctgggaggcggaggttgcagtgagctgaaatcatgccattgcactccagcctgggctacagagtgagaccctgtctcaaaaaagaaaaaaaagaaagaaaaagaaacaaggaaatcgtagtaccataagaggaaagaatgacacactcctacactcctgcaagacatccaagattacaaaaaaccagactgctggttcctgctgggatgatcacactacagctgtgctagatgaccacnccccagactcgctctttactgagcntgtttgaagaagatgctgcaccctcataacacttggtctggtccag

SEQ ID NO: 429775 - DNA, 1535 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaaataatcctccaggctggagagcagaaagcgcaaatgcagagtggactatgtgccataagcaacatctccagaccgatctacctggaccgagaacccctgtggccatccgcgatcccacgtctcgaagccagaaccggctctgccacccccagctgactcccccatttaaacaggctttggcgacaacaccaccaacagctctagccccccaacgaaaacctggcgaaatccccgcaaaccgagagcacacagacacacta

SEQ ID NO: 429776 - DNA, 986 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacaggtaggggagtccctccctgagggctgaaacctaagctagctgtggcgttctgctgagagggcacgcaggagacactgaagcatcgtcgtagaaagaaacataaatgcacaatctccctggctactttgtgggattcagcacttggac

SEQ ID NO: 429777 - DNA, 281 bp, Homo sapiens
cctaggttaatttattaccaagataataatagtttgttgaacttagttacagttaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaattattctgtttcttt

SEQ ID NO: 429778 - DNA, 1356 bp, Homo sapiens
acaccgcaatttgagagccccactggtataaagtgagtgaaacccaggcagagacaggcaaaatggtgaggcccgcatcctattggtgagtcacacagggaacgctgaaattcatggccttctccaggctactgggaacccatgggcggtgatggagggagtggtgccaccttcacttgctgctgaggctcttccccctctccccagcatactccttacctggctgtctctcctcatgtataaggaacctatagtggtgtagaatctactcttcttccccctgtggcttccaggcccccctgtatagctgctatccagcccgatttctcaccactggcccagggcttcctcctgccccgtggcttcacgtctctgaacacatcaatctctgatgttctctctccttccattgaattccaccagacacattcagggtttacttcgtaatgtcttcatatgagtatcaatcaacaccttccccaactcaattgtactaggttgtagagcacaaggatggtctcgtgctgctctgtggcacctgtgcctacactcctctgagctttgaggaggctgctctctttgctgaccccatgatcttttctgcccttctgttaagggcattggccacagcaacggggcaaatgccccaagctggctgtaagtgacccatccctttggctcccatgattagaccaaggagaggcatggggtccagctgagccattcagaaccattccttagcattttccactcaaaggttagagatgagattttctcttcccaaggctacctctggccatggttccagcttcatgggggcaatgggattaggaaaatgaggtcaacctgcaaaggaaagcagatgcaagagatggagacagaatgggggtgtcctggggatcttggagcctgaattcattggcacaaaaggcagcagcatcctcactgtatctgcagtccatttggactcaataaaaactttgaaagtcacatgtgttatggaattccttctcagtgacacattcatctgtgctcagttgtcccagcaagggtcagcccctcatacccctgcagcatccgctgctatgaagcagagctgtaaacgccctccctgtgtataggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttaattgtgcat

SEQ ID NO: 429779 - DNA, 3505 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaaaatacct

SEQ ID NO: 429780 - DNA, 594 bp, Homo sapiens
tctagagcggccgcctactactactaaattcgcggccgcgtcgacgcttcatgggggcaatgggattaggaaaatgaggtcaacctgcaaaggaaagcagatgcaagagatggagacagaatgggggtgtcctggggatcttggagcctgaattcattggcacaaaaggcagcagcatcctcactgtatctgcagtccatttggactcaataaaaactttgaaagtcacatgtgttatggaattccttctcagtgacacattcatctgtgctcagttgtcccagcaagggtcagcccctcatacccctgcagcatccgctgctatgaagcagagctgtaaacgccctccctgtgtataggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttaattgtgcat

SEQ ID NO: 429781 - DNA, 464 bp, Homo sapiens
cacagctctgagatgctctgattcctggcaggtagggtggcaccctaaattgtacccaaatgaccccagcaacctttgtctctataggacgctgtgtctgctctgttggaacagacagcagtggagctggagaagaggcaggagggcaggagcagcacacagacactggaagacagctggtgagtgagcccgcccttgggccccaggagctgccctgcctggacctaggcccagcaatgagatcccccaatgccagtgcaactaagagaagggttccactgggaaggctgagaacccctctcctcatgggttctctacaggcaaaaaggcaatgtaacctagtacgatggttcccagaattcctttcgaatttgccatttcgtttcccatgaatcacctatgctagttcacacctaatgttattctttatcttgatatagtgacatttattttgctaaaaaaaa

SEQ ID NO: 429782 - DNA, 627 bp, Homo sapiens
  misc_feature (615)..(615): n is a, c, g, or t
tgtcagtgactcagtacttgttatgtgccagacacccttcccaatcattctgatgaatgaatttttcttatctttaaggcctggggaattggcccaatgttacatacctaataagcagtcacatcaggtcataacaacagtagcaaggacttactatgtgccaagtactgtgctttgcaggttacagattatatcataaaaccttcaaccaaaataacatgaggaaagagcttttgttattccattcagagagatgagcaacttgcccaaggccacacagccggtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccagatcgccaacctgaagatccagctccgttctagngatcctctagat

SEQ ID NO: 429783 - DNA, 2934 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaaaatacct

SEQ ID NO: 429784 - DNA, 3688 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaagactttcctgtcaatgtggccaggcaactcccagcaattcggagcttacacactaccagctcccccaggcgtccagcaaaacagcaagacatctgtatttggacagccacttcttgttctctctgaagaggaccactctgaaccttggatctgttccatcctgcaggaatgcctgtcttagatggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaaaatacct

SEQ ID NO: 429785 - DNA, 3746 bp, Homo sapiens
tgtcagtgactcagtacttgttatgtgccagacacccttcccaatcattctgatgaatgaatttttcttatctttaaggcctggggaattggcccaatgttacatacctaataagcagtcacatcaggtcataacaacagtagcaaggacttactatgtgccaagtactgtgctttgcaggttacagattatatcataaaaccttcaaccaaaataacatgaggaaagagcttttgttattccattcagagagatgagcaacttgcccaaggccacacagccggtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccagatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaaaatacct

SEQ ID NO: 429786 - DNA, 3475 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaaaatacct

SEQ ID NO: 429787 - DNA, 2924 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcaggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttaattgtgcat

SEQ ID NO: 429788 - DNA, 1088 bp, Homo sapiens
ttatcgttctgaatgaagtggatcccacatggagcaagagtgagggtgccgtccctacagtagccccctctgttgtgatagcgagttctccttgcccctttctggaggccccctccactgactcagggccttgcttgctttgcccagcagatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaaaatacct

SEQ ID NO: 429789 - DNA, 758 bp, Homo sapiens
ttcttttttagtagagatggggttttaccatgttggccaggctggtcttgaactcctgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaaaatacct

SEQ ID NO: 429790 - DNA, 2643 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggtttgcagaaccagaagaaaccaggagccagaatgtcagaaagaaaaaaggggccaggcgtggtggctcacgcctgtaatcccagcactttgggaggccgaggcaggtggatcacctgaggtcaggagttcgagaccagcctcagcattgagaaactccgtctctactaaaaatacaaaattagctgggcgtggtggtgcatgcctgtaatcccagctactcgggaggctgaggcaggagaattgcttgaacctgggaggcggaggttgcagtgagccgagatcgcgccgttgcactccagctgggcaacaagagtgaaactacatctc

SEQ ID NO: 429791 - DNA, 2437 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggtgagctgggaccaggtgtgccaccttcccacaaggccgcacccggatgttggaagggaaagcctctcccagaactggaggtgatcaggcgtcatgagaggagaacaatggggtggaggaagtaggagaagaagacagggaaggagagatctccactaaggggcaggcggctccctttctgcaacttgttcccttccacatctgtgtttcctccttctgtcctttgccctacctaataccacttggctaacgaaaaccttaattcatgattttttacaaatgaagtggagaagaaggtaaaaaactgtggaaggaaaaagattaacctttcttgggcccctactttgttcaaggtccatactggaggctttgtataagaggcagctagaaatcatgggaagagaatcagagggctaggtcagtcatatcacctctctgagctttcaatttttaatgtctaatatgagccttaaaaggttgttatgaggatgggcacggagcctcatgcctataatcccagccctttgggaggctgaggcaggaggatctcttgaggccaggaattcaagacaagcctgggcaacatggtgaggccttgtctctac

SEQ ID NO: 429792 - DNA, 2209 bp, Homo sapiens
aaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggtgagtgagcccgcccttgggccccaggagctgccctgcctggacctaggcccagcaatgagatcccccaatgccagtgcaactaagagaagggttccactgggaaggctgagaacccctctcctcatgggttctctacaggcaaaaaggcaatgtaacctagtacgatggttcccagaattcctttcgaatttgccatttcgtttcccatgaatcacctatgctagttcacacctaatgttattctttatcttgatatagtgacatttattttgctaaaaaaaa

SEQ ID NO: 429793 - DNA, 183 bp, Homo sapiens
cttgtgagagaactggaggaagccacccggcaggtggcaactctgcactcccagctgaaaaggtgagtggtgggcggtgaggccactgctcccctgggcatggccagacatgggtgtccccagtgtcccagcccaggctctacccttcacttgtcctccgtggcttgagagtggatgtttaga

SEQ ID NO: 429794 - DNA, 742 bp, Homo sapiens
gatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccagatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggtggggctggggccccagggtgtgtaggacccttctctcactggcagtctgtcctcagcccccagatgggggaagaatgagggggctccgggcccctgggctccaccctgagcacgctcagttcagagatctctcaggttgccgacataggaaatcaggaaagatggtttgccatccagtgcgccagctaccctggaattttgcatggtgaatcatgctaccaa

SEQ ID NO: 429795 - DNA, 786 bp, Homo sapiens
cacaggtagtagggaagaatgtactcgtgttaattgtgtatgatcgtttccatctccctggattcattggcctgcatgatgttatctttactcagacggctcctctaaccatgtttacaactatcaaccctgtgatcatccacggcagccttgtgacagttcgtgcccttgtgtgatagcacaaaatttttgtgaaaagttttgtcaatgtagttcagagtgtaagtatttgttgctttgatgcaattgcatgagaactaaataggtctttggttagcaatttaaaaaatcaaaaataagaacatgggagcactcccttgtttacttgacgaaactcatcaatttgacaagtatttattgagccccatacctggccctgtgccagtggccagtcagtcgcctgggtgttgtgtgtctgtgtgtgtgaggcaggcaaagttgtattaaaggaacctgaattttatttttttcttctttgatcatttaaattaagttgtattaaagttggcacagattgtaagaggaatctagaaggagctacccaaataatttttgggcaccagaaatcgtcagagttaggagggttttagtcttcagattaaaggaatgtagcataaacatagtagatttttataattgtttaatgagactgcacatgaagcttgggtattaagggagtgtttagaactaggggctattggaatggtcaaggaccatggatattgttccatccagaccctttattcacaccgactttaaatatatacactatttaacaaaaaaaaa

SEQ ID NO: 429796 - DNA, 560 bp, Homo sapiens
tgagttttagatgcactgtcatttcagctatgtgataggttccacagattttttttttttaaatgatggagaacaggtaaggggttaggaaaatatgaggtagaaaagttgtttttacgggtactctcttatttttaccatttcccctctttgaaccaagccactcctacctaggaactaaatgggtatatattgcctgttggattttggacagaagattcattgaatggcacctgcagaaggtatcctatttttaagcaatttggtttttgtagaatgaagtataaaactgttggctgctgtcaaacttctcccttctatttccactaaaaaaatggaattcttgagcacttgttttataatattctttacaaggcagaattttgtttggctcatctaaaatgtttctgtggtctctataaaccatgctcttaccattgttttatactttgagactggattattgtacttcataatgcaagatgtaaccctcacagtcttattcctgaagttcctttcatgtcttcctgtggctgtgtatccttcacaggaaaaaaaaa

SEQ ID NO: 429797 - DNA, 3161 bp, Homo sapiens
  misc_feature (2821)..(2821): n is a, c, g, or t
  misc_feature (2824)..(2824): n is a, c, g, or t
  misc_feature (2856)..(2856): n is a, c, g, or t
  misc_feature (2875)..(2875): n is a, c, g, or t
  misc_feature (2878)..(2879): n is a, c, g, or t
  misc_feature (2910)..(2910): n is a, c, g, or t
  misc_feature (2921)..(2921): n is a, c, g, or t
  misc_feature (2956)..(2956): n is a, c, g, or t
ggagtagcttcgcctctgacgtttccccacgacgcaccccgaaatccccctgagctccggcggtcgcgggctgccctcgccgcctggtctggctttatgctaagtttgagggaagagtcgagctgctctgctctctattgattgtgtttctggagggcgtcctgttgaattcccacttcattgtgtacatccccttccgttccccccaaaaatctgtgccacagggttactttttgaaagcgggaggaatcgagaagcacgatcttttggaaaacttggtgaacgcctaaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429798 - DNA, 3005 bp, Homo sapiens
  misc_feature (2)..(2): n is a, c, g, or t
  misc_feature (32)..(32): n is a, c, g, or t
  misc_feature (100)..(104): n is a, c, g, or t
  misc_feature (2665)..(2665): n is a, c, g, or t
  misc_feature (2668)..(2668): n is a, c, g, or t
  misc_feature (2700)..(2700): n is a, c, g, or t
  misc_feature (2719)..(2719): n is a, c, g, or t
  misc_feature (2722)..(2723): n is a, c, g, or t
  misc_feature (2754)..(2754): n is a, c, g, or t
  misc_feature (2765)..(2765): n is a, c, g, or t
  misc_feature (2800)..(2800): n is a, c, g, or t
gnaaataaaagcgatggcgattgggctgccgnttttggcgctcggtccggtcgcgtccgacacccggtgggactcagaaggcagtggagccccggtgttnnnnnaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429799 - DNA, 2915 bp, Homo sapiens
  misc_feature (2)..(2): n is a, c, g, or t
  misc_feature (32)..(32): n is a, c, g, or t
  misc_feature (2575)..(2575): n is a, c, g, or t
  misc_feature (2578)..(2578): n is a, c, g, or t
  misc_feature (2610)..(2610): n is a, c, g, or t
  misc_feature (2629)..(2629): n is a, c, g, or t
  misc_feature (2632)..(2633): n is a, c, g, or t
  misc_feature (2664)..(2664): n is a, c, g, or t
  misc_feature (2675)..(2675): n is a, c, g, or t
  misc_feature (2710)..(2710): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429800 - DNA, 2797 bp, Homo sapiens
  misc_feature (2457)..(2457): n is a, c, g, or t
  misc_feature (2460)..(2460): n is a, c, g, or t
  misc_feature (2492)..(2492): n is a, c, g, or t
  misc_feature (2511)..(2511): n is a, c, g, or t
  misc_feature (2514)..(2515): n is a, c, g, or t
  misc_feature (2546)..(2546): n is a, c, g, or t
  misc_feature (2557)..(2557): n is a, c, g, or t
  misc_feature (2592)..(2592): n is a, c, g, or t
ccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429801 - DNA, 3475 bp, Homo sapiens
  misc_feature (2)..(2): n is a, c, g, or t
  misc_feature (32)..(32): n is a, c, g, or t
  misc_feature (3135)..(3135): n is a, c, g, or t
  misc_feature (3138)..(3138): n is a, c, g, or t
  misc_feature (3170)..(3170): n is a, c, g, or t
  misc_feature (3189)..(3189): n is a, c, g, or t
  misc_feature (3192)..(3193): n is a, c, g, or t
  misc_feature (3224)..(3224): n is a, c, g, or t
  misc_feature (3235)..(3235): n is a, c, g, or t
  misc_feature (3270)..(3270): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtaagatatccgataaaaatgttgttaaaagagcttcaaacatagagataaaactgtactcgttgtccaaacaaagaaaattcttggttattactaagctcctattcatctcctaaaaataatttttttttcttcccaagagggaattgaatgaaaattattctccaggtatgttacagaatttccccaatgtagacttttaaggttagatagcagtagcttttaaaagctagtaagaattgaaatttagcatcacagttcttgaccagaatataattacagctacccctaatgtgagggtagggacagcgatgtgtgttatatccccagcatctagcagtgtcacagaagagacaaagacatttttctggtatgcatgagtataagaatggtttgcctaaataagactgtcctcatggctctgtgactgtgcctcttgtcaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429802 - DNA, 2127 bp, Homo sapiens
  misc_feature (1787)..(1787): n is a, c, g, or t
  misc_feature (1790)..(1790): n is a, c, g, or t
  misc_feature (1822)..(1822): n is a, c, g, or t
  misc_feature (1841)..(1841): n is a, c, g, or t
  misc_feature (1844)..(1845): n is a, c, g, or t
  misc_feature (1876)..(1876): n is a, c, g, or t
  misc_feature (1887)..(1887): n is a, c, g, or t
  misc_feature (1922)..(1922): n is a, c, g, or t
agaactgtcttgcctgatttttgtaccattctaggaatatatagaacccatatttctctttctgaaattttcagactatcaaaagcatatcaaaacaagtatattagacatgcaaatgattatttgtgataaatggataatgtgatacattttttgactaacctggcttatatagtatttttttttctcttccatcaaaatgagttttagaactttgccctgatgttgacatttttcatttcgtaggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429803 - DNA, 2515 bp, Homo sapiens
  misc_feature (2175)..(2175): n is a, c, g, or t
  misc_feature (2178)..(2178): n is a, c, g, or t
  misc_feature (2210)..(2210): n is a, c, g, or t
  misc_feature (2229)..(2229): n is a, c, g, or t
  misc_feature (2232)..(2233): n is a, c, g, or t
  misc_feature (2264)..(2264): n is a, c, g, or t
  misc_feature (2275)..(2275): n is a, c, g, or t
  misc_feature (2310)..(2310): n is a, c, g, or t
aggattaaggatgtataatgcattgaataattttcttagttggttagtttcagtataaagaccagagttatctcaagaatgtgtagctgtgttgtttctgtttcctgcctgcacccgtaccctagcttgtggtgtttgccctgcttggttgtttgaaagctgatgatgcactttattctcattctttgtgccattttcttttttcgatctttctcaggtagggaataatgaaatttggatcatttggtttaatattcttgacgttctgtgagtagttttgttggaaaatgtgaactacgatgggttagtgttttgccgattggatttgagttgtcctcatcttttcgcttttttcttaagcacaccctgaattgtacttcttaatattatttccaatcatttcttgaccagtgcttacatttggttttgtagaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtaagatatccgataaaaatgttgttaaaagagcttcaaacatagagataaaactgtactcgttgtccaaacaaagaaaattcttggttattactaagctcctattcatctcctaaaaataatttttttttcttcccaagagggaattgaatgaaaattattctccaggtatgttacagaatttccccaatgtagacttttaaggttagatagcagtagcttttaaaagctagtaagaattgaaatttagcatcacagttcttgaccagaatataattacagctacccctaatgtgagggtagggacagcgatgtgtgttatatccccagcatctagcagtgtcacagaagagacaaagacatttttctggtatgcatgagtataagaatggtttgcctaaataagactgtcctcatggctctgtgactgtgcctcttgtcaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429804 - DNA, 1748 bp, Homo sapiens
  misc_feature (1408)..(1408): n is a, c, g, or t
  misc_feature (1411)..(1411): n is a, c, g, or t
  misc_feature (1443)..(1443): n is a, c, g, or t
  misc_feature (1462)..(1462): n is a, c, g, or t
  misc_feature (1465)..(1466): n is a, c, g, or t
  misc_feature (1497)..(1497): n is a, c, g, or t
  misc_feature (1508)..(1508): n is a, c, g, or t
  misc_feature (1543)..(1543): n is a, c, g, or t
atttctgaccacgtagttcacttgcttggtttatgatgcctgaaataagaggaagtgatcagtgtcatccacatcagaataaatcaacaggcagacacacctgctgctttgtgcagcattgggagctcaggagttctgaccaggagtcatggatgaacacaggaaatgacgtcttgccacacctggggcagcctgagccatcaagctgtttgagttgcttcaaactgatggcaaatataaactgggcagggcatgactcttggctttaacgcattcctgtattcatggcacagatagatccagttaagcagctctctgttggatttgtagcttcccgcagaaatttggtttaattttctttgtgtttttgcaggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429805 - DNA, 1304 bp, Homo sapiens
  misc_feature (964)..(964): n is a, c, g, or t
  misc_feature (967)..(967): n is a, c, g, or t
  misc_feature (999)..(999): n is a, c, g, or t
  misc_feature (1018)..(1018): n is a, c, g, or t
  misc_feature (1021)..(1022): n is a, c, g, or t
  misc_feature (1053)..(1053): n is a, c, g, or t
  misc_feature (1064)..(1064): n is a, c, g, or t
  misc_feature (1099)..(1099): n is a, c, g, or t
ttcgcatagctacgtcgtgaggatgtgatactctcagaaaaagagagcacacacggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429806 - DNA, 2721 bp, Homo sapiens
  misc_feature (2)..(2): n is a, c, g, or t
  misc_feature (32)..(32): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgataagtacgtcggtggggggggggggggggggggggtggcggggggcggtggtggggtgggtgcgggtggtgga

SEQ ID NO: 429807 - DNA, 3581 bp, Homo sapiens
  misc_feature (2)..(2): n is a, c, g, or t
  misc_feature (32)..(32): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatggtatgtttcagagctgggaggcagtgagttcctgagttgcatgtggcagccttctgccggccgagtgttcagaaacgagggtagaggtcagtgaggtgaccagaaggaggatctccttagaggcatggggggctgcttgcttgaaaggaactggagcaaggaattcctcagggagcagatagactagatgtgcaggaaaccgcctctctggagtcccggctgtctgtgggtggcactatcccagcatctggctgtgaaggggacgttgtgctcttgctgctcacctcacctcttgtgttcaggcagctcagcacacctcctccagtcagtgcctctgagcggggaaggaggggaggagcactgcatttgcaaccatcttccagactcccctggatattctcaaaggactgagaggaaaggcagctgctttcatagctgatgttctggggtagaatgtaaggctgtgtagggatgtttctggtgggattatgtgaaaatggaggtaggcttaacatgtaagatattcagagaaactcttagttggaacaagtagaataggtttttttctatgaatgctttatagacattataatgaaaaaaactaattttaaatgtgaaaatgcctattcgtgatgtttggaagaattttgtcagatttttttttttttttgctatgttttgctcagtaatgtatgtttatagttgataattaatagcttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttagattttgtggtggatgcaacccgcaagggtaacaaaattcgttttgcaaatcattcggtaaatccaaactgctatgcaaaaggtaggtacctttgacgtgagaattggaactcccttttcagtcctgtgatgatggacttgaatacttctgggatagttgtttgttatgtgaacaagtcagttaaccccccgtggcccgtcttcatgctcactgacaccagtgtgtctctttgcagttatgatggttaacggtgatcacaggataggtatttttgccaagagagccatccagactggcgaagagctgttttttgattacaggttggtaaagtacatttctagcatgatctctaagggctttttctactggattgtgaactctggacaaaggagggtttttagttctttgcttcttttgatgggtcactttgccatgagcattagtggggaattaggtta

SEQ ID NO: 429808 - DNA, 2129 bp, Homo sapiens
  misc_feature (2)..(2): n is a, c, g, or t
  misc_feature (32)..(32): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggtgagtctgtcatgaagctccttagagaagtcaacatagatagacactgcaggcaaggcccttcctaagggctgttgttggtttctacttagtctatttttaaaaaaccttaaactgccatcaaaaacagaactatggaatcttatttccactgggaattgctagtatttttctataagaatacagcagccttcagtatatttggtatgttaagagtcataaaaattacggttaccagactgcatttgggttaagaaaaacatatttagtagcttttgcagtaaaggttacgtaaacaattactttaacatcatgaaatgttctgtgtttctgatgtgagctctgggccagtttttagaagtatcttttattccaggagcttgaatttctaagttgtgtggcattgcattccgatactcctaatgggtaccctactttaagcttgtgtgaatgttattttcaccttagcgaa

SEQ ID NO: 429809 - DNA, 2141 bp, Homo sapiens
  misc_feature (1801)..(1801): n is a, c, g, or t
  misc_feature (1804)..(1804): n is a, c, g, or t
  misc_feature (1836)..(1836): n is a, c, g, or t
  misc_feature (1855)..(1855): n is a, c, g, or t
  misc_feature (1858)..(1859): n is a, c, g, or t
  misc_feature (1890)..(1890): n is a, c, g, or t
  misc_feature (1901)..(1901): n is a, c, g, or t
  misc_feature (1936)..(1936): n is a, c, g, or t
tgcggccgctccaacatcagaatgaaaaaaaaagctatcactgtaaatcctcagacctgtttgtctaaggatttacagtgatagcttttgttttcattctgtagtctactttgtccccagtccattttcaccctccttttttgatgatgcgattgtgttttattctctagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatggtatgtttcagagctgggaggcagtgagttcctgagttgcatgtggcagccttctgccggccgagtgttcagaaacgagggtagaggtcagtgaggtgaccagaaggaggatctccttagaggcatggggggctgcttgcttgaaaggaactggagcaaggaattcctcagggagcagatagactagatgtgcaggaaaccgcctctctggagtcccggctgtctgtgggtggcactatcccagcatctggctgtgaaggggacgttgtgctcttgctgctcacctcacctcttgtgttcaggcagctcagcacacctcctccagtcagtgcctctgagcggggaaggaggggaggagcactgcatttgcaaccatcttccagactcccctggatattctcaaaggactgagaggaaaggcagctgctttcatagctgatgttctggggtagaatgtaaggctgtgtagggatgtttctggtgggattatgtgaaaatggaggtaggcttaacatgtaagatattcagagaaactcttagttggaacaagtagaataggtttttttctatgaatgctttatagacattataatgaaaaaaactaattttaaatgtgaaaatgcctattcgtgatgtttggaagaattttgtcagatttttttttttttttgctatgttttgctcagtaatgtatgtttatagttgataattaatagcttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttagattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429810 - DNA, 805 bp, Homo sapiens
  misc_feature (465)..(465): n is a, c, g, or t
  misc_feature (468)..(468): n is a, c, g, or t
  misc_feature (500)..(500): n is a, c, g, or t
  misc_feature (519)..(519): n is a, c, g, or t
  misc_feature (522)..(523): n is a, c, g, or t
  misc_feature (554)..(554): n is a, c, g, or t
  misc_feature (565)..(565): n is a, c, g, or t
  misc_feature (600)..(600): n is a, c, g, or t
tttttttaaagacattttaatgcacccactatcttcagcaggctttgttgtgttaagtcaagtctcagcacatgttggatgggtggccatccagcggacatctccttcctgttgtttcagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429811 - DNA, 803 bp, Homo sapiens
  misc_feature (463)..(463): n is a, c, g, or t
  misc_feature (466)..(466): n is a, c, g, or t
  misc_feature (498)..(498): n is a, c, g, or t
  misc_feature (517)..(517): n is a, c, g, or t
  misc_feature (520)..(521): n is a, c, g, or t
  misc_feature (552)..(552): n is a, c, g, or t
  misc_feature (563)..(563): n is a, c, g, or t
  misc_feature (598)..(598): n is a, c, g, or t
aagtaagtagatattactaaatagaaaagaaacggcaaagacacaagaaagcaaaaatacggtagaaatagtgcccagtaagtagtacgctagcacgaagtcacgcagcaatagacacaaataattagggagataacatacaatgccttcatagacgaaagaaaagcgcaattagtaaaggaaatgaagacctaaaccttcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429812 - DNA, 786 bp, Homo sapiens
  misc_feature (2)..(2): n is a, c, g, or t
  misc_feature (32)..(32): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatggtatgcctgattattaggatt

SEQ ID NO: 429813 - DNA, 799 bp, Homo sapiens
cagaaggtccagtattcactctgtgcgcttttgtgtgttctgtcaggcttgatcacctttatccaaaagaattttctcctgtgtctttctttttagattatttctcaagatgaagctgacagaagagggaaagtgtatgataaatacatgtgcagctttctgttcaacttgaacaatggtatgtttcagagctgggaggcagtgagttcctgagttgcatgtggcagccttctgccggccgagtgttcagaaacgagggtagaggtcagtgaggtgaccagaaggaggatctccttagaggcatggggggctgcttgcttgaaaggaactggagcaaggaattcctcagggagcagatagactagatgtgcaggaaaccgcctctctggagtcccggctgtctgtgggtggcactatcccagcatctggctgtgaaggggacgttgtgctcttgctgctcacctcacctcttgtgttcaggcagctcagcacacctcctccagtcagtgcctctgagcggggaaggaggggaggagcactgcatttgcaaccatcttccagactcccctggatattctcaaaggactgagaggaaaggcagctgctttcatagctgatgttctggggtagaatgtaaggctgtgtagggatgtttctggtgggattatgtgaaaatggaggtaggcttaacatgtaagatattcagagaaactcttagttggaacaagtagaataggtttttttctatgaatgctttatagacattataatgaaaaaaactaattttaaatgtgaaaat

SEQ ID NO: 429814 - DNA, 3032 bp, Homo sapiens
  misc_feature (2)..(2): n is a, c, g, or t
  misc_feature (32)..(32): n is a, c, g, or t
  misc_feature (2692)..(2692): n is a, c, g, or t
  misc_feature (2695)..(2695): n is a, c, g, or t
  misc_feature (2727)..(2727): n is a, c, g, or t
  misc_feature (2746)..(2746): n is a, c, g, or t
  misc_feature (2749)..(2750): n is a, c, g, or t
  misc_feature (2781)..(2781): n is a, c, g, or t
  misc_feature (2792)..(2792): n is a, c, g, or t
  misc_feature (2827)..(2827): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429815 - DNA, 2779 bp, Homo sapiens
  misc_feature (2)..(2): n is a, c, g, or t
  misc_feature (32)..(32): n is a, c, g, or t
  misc_feature (2439)..(2439): n is a, c, g, or t
  misc_feature (2442)..(2442): n is a, c, g, or t
  misc_feature (2474)..(2474): n is a, c, g, or t
  misc_feature (2493)..(2493): n is a, c, g, or t
  misc_feature (2496)..(2497): n is a, c, g, or t
  misc_feature (2528)..(2528): n is a, c, g, or t
  misc_feature (2539)..(2539): n is a, c, g, or t
  misc_feature (2574)..(2574): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429816 - DNA, 3005 bp, Homo sapiens
  misc_feature (2)..(2): n is a, c, g, or t
  misc_feature (32)..(32): n is a, c, g, or t
  misc_feature (2665)..(2665): n is a, c, g, or t
  misc_feature (2668)..(2668): n is a, c, g, or t
  misc_feature (2700)..(2700): n is a, c, g, or t
  misc_feature (2719)..(2719): n is a, c, g, or t
  misc_feature (2722)..(2723): n is a, c, g, or t
  misc_feature (2754)..(2754): n is a, c, g, or t
  misc_feature (2765)..(2765): n is a, c, g, or t
  misc_feature (2800)..(2800): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429817 - DNA, 3114 bp, Homo sapiens
  misc_feature (2)..(2): n is a, c, g, or t
  misc_feature (32)..(32): n is a, c, g, or t
  misc_feature (2774)..(2774): n is a, c, g, or t
  misc_feature (2777)..(2777): n is a, c, g, or t
  misc_feature (2809)..(2809): n is a, c, g, or t
  misc_feature (2828)..(2828): n is a, c, g, or t
  misc_feature (2831)..(2832): n is a, c, g, or t
  misc_feature (2863)..(2863): n is a, c, g, or t
  misc_feature (2874)..(2874): n is a, c, g, or t
  misc_feature (2909)..(2909): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttgccactcctacctaggaactaaatgggtatatattgcctgttggattttggacagaagattcattgaatggcacctgcagaaggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429818 - DNA, 3974 bp, Homo sapiens
  misc_feature (2)..(2): n is a, c, g, or t
  misc_feature (32)..(32): n is a, c, g, or t
  misc_feature (3634)..(3634): n is a, c, g, or t
  misc_feature (3637)..(3637): n is a, c, g, or t
  misc_feature (3669)..(3669): n is a, c, g, or t
  misc_feature (3688)..(3688): n is a, c, g, or t
  misc_feature (3691)..(3692): n is a, c, g, or t
  misc_feature (3723)..(3723): n is a, c, g, or t
  misc_feature (3734)..(3734): n is a, c, g, or t
  misc_feature (3769)..(3769): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatggtatgtttcagagctgggaggcagtgagttcctgagttgcatgtggcagccttctgccggccgagtgttcagaaacgagggtagaggtcagtgaggtgaccagaaggaggatctccttagaggcatggggggctgcttgcttgaaaggaactggagcaaggaattcctcagggagcagatagactagatgtgcaggaaaccgcctctctggagtcccggctgtctgtgggtggcactatcccagcatctggctgtgaaggggacgttgtgctcttgctgctcacctcacctcttgtgttcaggcagctcagcacacctcctccagtcagtgcctctgagcggggaaggaggggaggagcactgcatttgcaaccatcttccagactcccctggatattctcaaaggactgagaggaaaggcagctgctttcatagctgatgttctggggtagaatgtaaggctgtgtagggatgtttctggtgggattatgtgaaaatggaggtaggcttaacatgtaagatattcagagaaactcttagttggaacaagtagaataggtttttttctatgaatgctttatagacattataatgaaaaaaactaattttaaatgtgaaaatgcctattcgtgatgtttggaagaattttgtcagatttttttttttttttgctatgttttgctcagtaatgtatgtttatagttgataattaatagcttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttagattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429819 - DNA, 4128 bp, Homo sapiens
  misc_feature (2)..(2): n is a, c, g, or t
  misc_feature (32)..(32): n is a, c, g, or t
  misc_feature (3788)..(3788): n is a, c, g, or t
  misc_feature (3791)..(3791): n is a, c, g, or t
  misc_feature (3823)..(3823): n is a, c, g, or t
  misc_feature (3842)..(3842): n is a, c, g, or t
  misc_feature (3845)..(3846): n is a, c, g, or t
  misc_feature (3877)..(3877): n is a, c, g, or t
  misc_feature (3888)..(3888): n is a, c, g, or t
  misc_feature (3923)..(3923): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatggtatgtttcagagctgggaggcagtgagttcctgagttgcatgtggcagccttctgccggccgagtgttcagaaacgagggtagaggtcagtgaggtgaccagaaggaggatctccttagaggcatggggggctgcttgcttgaaaggaactggagcaaggaattcctcagggagcagatagactagatgtgcaggaaaccgcctctctggagtcccggctgtctgtgggtggcactatcccagcatctggctgtgaaggggacgttgtgctcttgctgctcacctcacctcttgtgttcaggcagctcagcacacctcctccagtcagtgcctctgagcggggaaggaggggaggagcactgcatttgcaaccatcttccagactcccctggatattctcaaaggactgagaggaaaggcagctgctttcatagctgatgttctggggtagaatgtaaggctgtgtagggatgtttctggtgggattatgtgaaaatggaggtaggcttaacatgtaagatattcagagaaactcttagttggaacaagtagaataggtttttttctatgaatgctttatagacattataatgaaaaaaactaattttaaatgtgaaaatgcctattcgtgatgtttggaagaattttgtcagatttttttttttttttgctatgttttgctcagtaatgtatgtttatagttgataattaatagcttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttagattttgtggtggatgcaacccgcaagggtaacaaaattcgttttgcaaatcattcggtaaatccaaactgctatgcaaaaggtaggtacctttgacgtgagaattggaactcccttttcagtcctgtgatgatggacttgaatacttctgggatagttgtttgttatgtgaacaagtcagttaaccccccgtggcccgtcttcatgctcactgacaccagtgtgtctctttgcagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaaaaaaaaaaaaacnccncccccccccaaaaaaacaaaaacaaaaaaacnaaaaaaaaaaaacccctcnaanncctcctcggctccgctcccttttgccccccncccttctggcnccgccgccgccatccctgcggtcttagatcaaagntttctttttgggtggggcttttatgtgttagttggccaaatttccggcgcgggggtgtgggaaaaacttaggggggaccctttttacacccctctggagaaggaaaccctttcggccccccccttttttatggggggggggacacaccaactctgcccccctcggggagtgttttttccaaggtttcgccacccgggtattggtg

SEQ ID NO: 429820 - DNA, 2389 bp, Homo sapiens
  misc_feature (2)..(2): n is a, c, g, or t
  misc_feature (32)..(32): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtaagtatttgttgctttgatgcaattgcatgagaactaaataggtctttggttagcaatttaaaaaatcaaaaataagaacatgggagcactcccttgtttacttgacgaaactcatcaatttgacaagtatttattgagccccatacctggccctgtgccagtggccagtcagtcgcctgggtgttgtgtgtctgtgtgtgtgaggcaggcaaagttgtattaaaggaacctgaattttatttttttcttctttgatcatttaaattaagttgtattaaagttggcacagattgtaagaggaatctagaaggagctacccaaataatttttgggcaccagaaatcgtcagagttaggagggttttagtcttcagattaaaggaatgtagcataaacatagtagatttttataattgtttaatgagactgcacatgaagcttgggtattaagggagtgtttagaactaggggctattggaatggtcaaggaccatggatattgttccatccagaccctttattcacaccgactttaaatatatacactatttaacaaaaaaaaa

SEQ ID NO: 429821 - DNA, 1205 bp, Homo sapiens
  misc_feature (2)..(2): n is a, c, g, or t
  misc_feature (32)..(32): n is a, c, g, or t
gnaaataaaagcgatggcgattgggctgccgnttttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttgccacattgaggaccaagagttgtgtgtttacgtacggtaaaccacaacgcagag

SEQ ID NO: 429822 - DNA, 787 bp, Homo sapiens
attttttgtaccagcgcgccttgtgttggtcccgggattcggccttatggccgggggcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429823 - DNA, 769 bp, Homo sapiens
ttgtggtttaaaccaggagtgcgccgcgtccgttcaccgcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429824 - DNA, 745 bp, Homo sapiens
cggacgcgtgggcgacccacgcgtccgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429825 - DNA, 871 bp, Homo sapiens
  misc_feature (783)..(783): n is a, c, g, or t
  misc_feature (794)..(794): n is a, c, g, or t
  misc_feature (797)..(797): n is a, c, g, or t
  misc_feature (799)..(799): n is a, c, g, or t
ttgtggtttaaaccaggagtgcgccgcgtccgttcaccgcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaattgggggccggccngaaagtttaanaancntggggggcccaggaagaatgtgcttgtcgcagacccgcaggatggtgtgcccccaaaaccgggcggttaaca

SEQ ID NO: 429826 - DNA, 920 bp, Homo sapiens
tgagtgaatgggagggtcgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaaaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatggtgattggcccctgttgcggcctgtttttaatttcttcgcctcaatgggggttggttaaaagtttttcaaaaaaa

SEQ ID NO: 429827 - DNA, 507 bp, Homo sapiens
aatatgttcctcgtgccatcctggtggatctagaacctgggaccatggactctgttcgctcaggtccttttggccagatctttagaccagacaactttgtatttggtcagtctggggcaggtacaaagttgtctggtctaaagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429828 - DNA, 735 bp, Homo sapiens
acttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccaggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaataccaacacgaccacccaccaccacacacacaccacacaaagtcaccaacacccccacgcgccacaccgcacaccacaccagtcagcagacacaa

SEQ ID NO: 429829 - DNA, 1106 bp, Homo sapiens
tgagtgaatgggagggtcgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaagtacttgttggctcacgcccgtgactgttccgctgtttagctcttgttttttgtgtggacactcctaggatagaaagtttggtatgttgctatacctttgcttctcccaccttccccaatatctaatatgtatttctcattcttagaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429830 - DNA, 960 bp, Homo sapiens
tgagtgaatgggagggtcgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaaaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429831 - DNA, 1003 bp, Homo sapiens
tgagtgaatgggagggtcgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaagtacttgttggctcacgcccgtgactgttccgctgtttagctcttgttttttgtgtggacactcctaggatagaaagtttggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429832 - DNA, 1050 bp, Homo sapiens
cggacgcgtgggcgacccacgcgtccgaatgcggctgttaagacctgcaataatccagaatggctactctgatctatgttgataaggaaaatggagaaccaggcacccgtgtggttgctaaggatgggctgaagctggggtctggaccttgtaagtatacaaggctgcagtcggatacactggtattgtggacgtggcctggagctggacgagacatttagtgtactttttgggcaattggagtcgtttgttattggtcctttttcatttttaatatcttaatgagatgatttaaggaagttactgaatctctgctattaggcctatcatagccatgccactaccaaaagtggggggtgggtttgggggtgagaggtcaagtttatatacacagtatttaagttgtacaggtattttgctgctggaatattcttatggtaagactttttcttcagcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429833 - DNA, 636 bp, Homo sapiens
cgaattcgagctccgttcaccaagcttggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429834 - DNA, 1644 bp, Homo sapiens
  misc_feature (1644)..(1644): n is a, c, g, or t
attttttgtaccagcgcgccttgtgttggtcccgggattcggccttatggccgggggcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaaaaaaaaaaaaaaaaaaaaaaaaaaaaaggggggggagacacaaaaagaattccccaagagggggccacaagataatcagaggatatcacacaagatctctcggcgcaccaacgacgggggccccaaataagggagagacccagaatcacaacagccaagacacggtggacacgacggaaacaaacacacagcccagacacgggggcaaacacgcgcgcacaccgcggacaccatgggacaaagcagacaccacccacaaaacaacaccgcggagggggaagaacaacaaaacaagtgcgcaaacagaacacaaccacagaaagagaaaaattaaaacggcccccaagacggcgacaacacaacaaaacaaccactacagagcgctcaacagccgagtaaaaacacaacaacggacaactaacacacaaaggaatgaaacaaagcggggccacacaccgacaccggaaatccggcgaacaactcacaccgagcgagggtcccagacaacaaatacacagacaacgaaaccgagaaacaagaccagcaagacgagcaggcaaaagacaaacaagacagaggagacgacgacgaacgcaaaggacaagaggacacaacgacgcgaggagcgagagcgagaggaagagacaacaaaaagacacaaaagaacaacaagcaagcagcgaagaacgacacacaaccacacgagacagcaggagcagaggcggagaaaacacaacgagcaagccaagaccaagagaggagaacaaaataaaaaaatacgagagcaggcggacgagagcacgagacgaacagacaaacgggaatcagaagcataacgatccgcgacgcgaacaacn

SEQ ID NO: 429835 - DNA, 1401 bp, Homo sapiens
attttttgtaccagcgcgccttgtgttggtcccgggattcggccttatggccgggggcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaaaaaaaaaaaaaaaaaaaaaaaaaaaaagaaaaaaaaaaaaaaaaaaaaaaaaaaaaaaagaaacaaaacaagcagggcggggggcgagcactaattatatactttcctcccgagtgggcggcacaacatttacgccagccccaccattctctagtctcaaacagcggtgcgccccatattgatggtgcgtcgttctattattcaatgagtgtgcagcggggctgcgccatttctttatctctacgtgtgcgtgtgggatgacgccacaatcgcttcttccctcgcagatgttcagttttctctgtgtgatggggcaatccgcccctccccctactctcgacgcgggggcggcgagcacgcaacacgttgagtccgcccgaaccaccacactccccaccccagagttataacctcctacccacttcgacaggaagccaattcataatcaccaatcctcccgcatgatcgctcatgtccatctatcgctgcagtcaccacaaaagccccgtccatcttcgcagctcgcccgacgccgtcggcatcatatatactaatagttgcccctcattccgtgagttatttttccagcgaccgtaaaacccatttttcatcgg

SEQ ID NO: 429836 - DNA, 1261 bp, Homo sapiens
attttttgtaccagcgcgccttgtgttggtcccgggattcggccttatggccgggggcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaaaaaaaaaaaaaaaaaaaaaaaaaaaaagaaaagaaaaaaaaaaaaaaacaaaagcaaaaagagagaggagccagcagacaaaaaacactaacactcaaaaaagaaacaaaacagaatataaaggcggtgcagccggtcgcactctcgacactacagctgagccggccacacacactcaacgctgcataccacaccatctctgcgtcagcacgcccgcgctgaccgaccaaccataaggggacagcgcggagcaaaaccaacgacgcgagcccaccgcgcgccgcccaccccctggctcaacaaaccaggacaccaacagcaaccaacaggaggcgcaaccaacaccacaacgcgcgcgggaacaaccacccgaacagccccgacacaactcaacgacgcgcgcccggagggcgcacaccacaggcccacaccgaaacggccagacaggcccgcccccacccgccgcggcacccc

SEQ ID NO: 429837 - DNA, 911 bp, Homo sapiens
attttttgtaccagcgcgccttgtgttggtcccgggattcggccttatggccgggggcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaaaaaaaaaaaatcgggggtttttttggggggggaaagaggttaaaagggcggtaactggttccgggaccatttttgtaaaggggaaatggggggccccaaggaggggataaagaaaggcggtaca

SEQ ID NO: 429838 - DNA, 889 bp, Homo sapiens
  misc_feature (801)..(801): n is a, c, g, or t
  misc_feature (812)..(812): n is a, c, g, or t
  misc_feature (815)..(815): n is a, c, g, or t
  misc_feature (817)..(817): n is a, c, g, or t
attttttgtaccagcgcgccttgtgttggtcccgggattcggccttatggccgggggcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaattgggggccggccngaaagtttaanaancntggggggcccaggaagaatgtgcttgtcgcagacccgcaggatggtgtgcccccaaaaccgggcggttaaca

SEQ ID NO: 429839 - DNA, 1150 bp, Homo sapiens
attttttgtaccagcgcgccttgtgttggtcccgggattcggccttatggccgggggcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagaacattaaaaagacatctcaaggatggagagctaataaaattaatactttctactgcatatggtgaagtgacagtaagtgaaactggcatttttaaactacaagcgaagaaggatgcagaacagagagactgctaatatggtttactgtcactgccttgatttgtgttgaggcaccagcagctttctccaccgctgccttggtaccatcattacaaatgtcaacccagtggaaaaaggtgtgaatattgtcttgaaaatagttttgacctcatggaccccctcaaagggtctcagaccacaagggatctacagcccacactaagaactgctgccctgacaaaaacgctttctctctgtaacagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaaaaaa

SEQ ID NO: 429840 - DNA, 871 bp, Homo sapiens
attttttgtaccagcgcgccttgtgttggtcccgggattcggccttatggccgggggcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagatagtatcttttgcaattgcgaaaagtgcttttggcctttagtttcttagtattcagctcagctgtaacttgttatgaatataatatatgaccaaaaactatgatgagactgtctgaatctgggttgctttggacaagtgtacttgttgatggaattatttgcaaggtatcatcttaggtcaggaggggaataggaacaaagatgtagaagacattgttcctgtctgtaaaagcttatcacctagaggaggtaagatgtattcatgaacattgaataagtcccattgtggacagtctttctcacaaggcttttagaagtgagctttatgtcaagttgagcaatgcctgagagtaatttggtaggattatttctttggtttgaaaaatctacataagacag

SEQ ID NO: 429841 - DNA, 570 bp, Homo sapiens
acgtagcggccaagatggcgctagcggttggagcaggggctctgctgcgacctttacggtagtgaggttagggacgatgggagagcagctttgttcctgaagtgccgtcgaggattaggatcgagtttcttcgatcgtgagggcaattattagtggcctctagccccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggtgcggtggctcacgcctgtaatcccaacactttgggaggccgaggcaggcggatcatctgagatcgagagttcgagaccagcttgaccaacatggggtttccctgtgttgaccaggttggtctcgatctcctgacctcgtgatccgcctcctcggctcccaaagtgtg

SEQ ID NO: 429842 - DNA, 471 bp, Homo sapiens
cgctctctgctacgtgtggcgtcacacgtagcggccaagatggcgctagcggttggagcaggggctctgctgcgacctttacggtagtgaggttagggacgatgggagagcagctttgttcctgaagtgccgtcgaggattaggatcgagtttcttcgatcgtgagggcaattattagtggcctctagccccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggtaggttcaccctcagcctttgttcttatttcatcttatttgtgg

SEQ ID NO: 429843 - DNA, 1846 bp, Homo sapiens
acgtagcggccaagatggcgctagcggttggagcaggggctctgctgcgacctttacggtagtgaggttagggacgatgggagagcagctttgttcctgaagtgccgtcgaggattaggatcgagtttcttcgatcgtgagggcaattattagtggcctctagccccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggtgcggtggctcacgcctgtaatcccaacactttgggaggccgaggcaggcggatcatctgagatcgagagttcgagaccagcttgaccaacatggagaaaccccgtctctactaaaagtacaaaattagccaggcatggtggcacatgcccgtaatcccagctactcgggaggctgaggcaggagagtagcttgagcccaggaggcggaggttgtggtgagccgagatcgcgccattgcacagcctgggcaacgagcgaaactccatctcaaaaaaataaataaaaatttttttaaaaaagaaaaaaaaaaactcgaggcaaaactaaccccctaataaaattaattaaccactcattcatcgacctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaatattctttatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcagcactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccacatcaagcccgaatgatatttcctattcgcctacacaattctccgatccgtccctaacaaactaggaggcgtccttgccctattactatccatcctcatcctagcaataatccccatcctccatatatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggc

SEQ ID NO: 429844 - DNA, 1942 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaactta

SEQ ID NO: 429845 - DNA, 3115 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgta

SEQ ID NO: 429846 - DNA, 3297 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgtaacagtaggattagcaattttcatttattccttccatatatatttactgaatggctactatatgcctggtattgttctttgaaagcagaaacagcaggaaaaaaagtccctccctcatagagtttacattctaaaagggaggaaatagataataaaatatacattacatttaaaaagtggctc

SEQ ID NO: 429847 - DNA, 1858 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaattttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaactta

SEQ ID NO: 429848 - DNA, 445 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaatatttggagaactcactgatgaaagtgagtgtacattctttattgtcttatt

SEQ ID NO: 429849 - DNA, 675 bp, Homo sapiens
taagtcagctgactattttgtgagatacatttatctcctgttttgggttgctgttttgtaattttaccttgacagtaccatatatttaaatgttgttactgaaatttgaatttctaggtaatttgaaataaatttccttgaatgcttatgttcactagattctcaaatgagccaggattgtttgactttaaaaataccaacatccaaagctgtccccttttgttacagttctttttttcatgcactaccggatattgaagaacaaacatggagccaaggctaccatggaagcctatgctagattatattaatttagttcgagattaccatgagttctgattgtgacttttcttatctacactgttattaaattatctaaaaagaaaggaactgaccattattaaaaataaaaatctctgaggttactttggttggttggtttataggctaagtgattggtttaagtataatctttactacttttctgatttctctgtttttttagcccaaatcaggcattgtgtttattttggtctttctcattcagacttttgttttcttcatatgtcagatgatatttaatccttttatatttggattttttagacagttgtgaatgcagtggcccaattttagttaactgaacctctgccttccggttcaagtatcttctct

SEQ ID NO: 429850 - DNA, 267 bp, Homo sapiens
tacctcttctccgaaaggcaacatcatatactggaatacagattcctccgggtgcacacgctccagctaatacaccagcagaagtgcctcacagcacaggtgggaaactgtaactgaatgatttatttaattccccttttataaagaagaactgcatttcttatcacatatgtgcctcataatgatggtcatgaaaacatgacaagttccttgaattccatttgaacccacaagaaacattaaattattttcattaaaattttaata

SEQ ID NO: 429851 - DNA, 3060 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaagcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgta

SEQ ID NO: 429852 - DNA, 2483 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaaaaaaaaaaaaaaaaaagcattgcggcctcgtgccgaattcggcacgaggggccgcaatgcttttttttttttttttttttttttttttgttccaaaaagtggttttggatggaaccggaacatggaacaggacacacagcaggatgcggagcagtgtcagatgaggccaaaaaggtgggtgggactggtcttcaggggctccagatgaggctgaggggctgggcctaggtcctggagtgggtcagctttggacccttctgggatctgggaagggc

SEQ ID NO: 429853 - DNA, 2409 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttaaaaaaaaaaaaaaaaaaaaaaaaaaaaaaaaaaaaaaaaaaaaaaaaaaaaaaaaaaaaaaaaaaagaggggggggggcggaaaaaagatatccccggggggggccacaaatacaggaaacacccagtttagggaacaaaggggggccccacataagagggagcgaaatataaaccaaaacaccgggggacacgtattaacaacgcgaggagggggagaacaagcggaaacggagaaccatggggaaaagacacacacaaagggagggagaggacaaccaacgggggcaaacacacccacccagaaaagtaacaagccactagagggggaaataactcaacactgtcagggggaaaaggtggttgtaacaacagggggaaaatagcggagggatgcaaagaatggtcgcaacaggggaatattatgatagagagaatcttacgggggggataagattaataaaaggg

SEQ ID NO: 429854 - DNA, 3034 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgta

SEQ ID NO: 429855 - DNA, 1411 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattcta

SEQ ID NO: 429856 - DNA, 1272 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagatgtcttgctcccatcaggatagtggtactcttcatcctgacagatggggtaacga

SEQ ID NO: 429857 - DNA, 3056 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgtcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgta

SEQ ID NO: 429858 - DNA, 3063 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaagtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgta

SEQ ID NO: 429859 - DNA, 2302 bp, Homo sapiens
gtaccctacctaaatggctgtaggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgta

SEQ ID NO: 429860 - DNA, 923 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgggaaactgtaactgaatgatttatttaattccccttttataaagaagaactgcatttcttatcacatatgtgcctcataatgatggtcatgaaaacatgacaagttccttgaattccatttgaacccacaagaaacattaaattattttcattaaaattttaata

SEQ ID NO: 429861 - DNA, 3388 bp, Homo sapiens
cctggtgaactcagagattccattcagtattaagaatgggattgttgaattttactcacagagaaatcactgtttcttcatgttgtaagatgttttctgtttgtgtatttgtatcatggttactcatcaaaagctctcattctgcctttgtagaattcagttcccttcctttcatcatagctaaagtgacttttttccctactattaacgtgatcctacatccttaaatctcatcgattacctcacttaggccttggaaccttggcccttggtcggtgtccttggtgtcttctaagcaaggctgtgcgttgttcagaaacgtggccagaccgcatttcctgctgctcccatgccgcatgccaggtggcctgagacagagctccccatacggctgcaaggtgctttacctgtgggctttggcagtaacccaagagaggatcagaaggtggagaaggtgccacgagtgatttaacaggcctgccacagggagtgccccccgcccagctcgttctcagcacaggttttctctttgggagtacccaggtgatttctagtgacccaattttgtgtcatctccctgttttagccccacttgcctagagacaactgtttccgatgccttttctgcttatcatactagtttctaaccacgcagatttctcaaaatcatttattcaatgtattttatttgagcacttagtgtattgagctaggcaggatatagggtgccggagatacagcgatgaacaagacaggcaaaacttctgctttcctaaaacttgtgatgagagagaacaataaaaaagtgttgctgccacaaagaaaccaaagtgtgtggggaagggcgcgtgtttgcggttacatctcttctgtcccagaatcacagggatctggtccggtcacctctggtctttcctcttagtcgcctttaggagccctggttcccgtccatcctctggggggtttgtttgaagagatctcgtgtgggtacttgtcatgaaaacaccttgggcatcatctggtgtatccagttctagtctcgagaattctggtttcccactgtgctcagcaagtggaaagttcttttcaggccagaacagctctgcaccatcacatatcgtgttgcggcttagctgtttggtctgtagttcaggttatgggacttctccaatcctggaaggctgttgagctttttagaagtactgtacgctatcttcaagatggagcttggtcacatctgttaggaatccaaaggacactatgacttatttaaatcttgtcttactaaacctctcttgggcacgtgtgccagaatttctcttgttgcttcttgagtctttttaatttcagtgttttttcgtttgttttttgtttttttgagacagagtctcgctctgtcacccaggctggagtgcagtggcacgacctcagctcactgcaacctccgcctccttggttcaagcaattctcctgcctcagcctcccgagtagctgggattacaggtgtgtgccaccacgctcggctaattttttatattttttttagtagagacggggtttccccatgttaggcaggatggtctcgatctcctaacctcgtgatccgcctgcctcagcctcccaaagtgctgggattacaggcttgagccaccgcacccggcctaatctcagtttttgaagtgctccacaagtcattaggcaccaaaacattttcacctggggaacactggcatttccctgattagctgtgaagcaatctagtggctaagtgtgaaatcctgggtgcgcaggtgttctcactcccgccgtgttctcagtgcagtggtggtcagaggcccttccaaggagacatcactctgatcagttacagatagatgttctggaagatctgcaggtgagtagatccagcagagtttcttcccaccaactctagaagaaagggccttatcagagttgaccctgagcctttggtaaggttttgtgtgcatgcgattcagttatctttggcaattcttttcttgctgcagtgagagattaattggttgctgatcaaaccgttcatgcagatggggggacctttggattgtacggctttctcctcttggctgctttcttttcaggaagttggactttggccaggtttggctttcccagagccgttcctttctctgtcctttccttgggtcctcatggtgtgcccattggatccttggccttgtgatcctctgggaactgggggccagttccacttttgcagccttctgtgctggaagagaagcccagcgccctggaaggagcctctttaagtcccccatgtcgctttctctctctgctcttttagtgtctgagattgcctttctttgaatttcccagtgtttcttttccttgtcccttccctcaccaacctggagttattttggttgactatgtcctggctttggcttctcctggcaggaagtcatcaggcatcctctccaggtgagccgaaattccaccctcccaggttggacatcatcttttaaacccaatggtctactcccctccttctttatgaaacagtgatttcccgtgagtaactctggttctgattttttgtaccggcgcttaaattctttctgtagacgttggaaagccacaaagaacgtgactgcagtgagcctcccactggagcagccttaaccaacactttggccaaagcccccccacctcccctgtgtactgtgtgtgtgtttggtggatacagtattccttttcagtgtccctaaagctgtgatggggagtccccacttacctagaaagcattaccagtcacctactctgcattctcagatgtaaaccttgtgtagtgttctttttgcaatgacctatttatttaacctatttatatttatttaatttttactctgaaatgtatccagttacaattgtacttgcttaaagcacatcagatttgttttggacaacacccttgaccattttaaaactggaaaagtgatactgtatccttccatgggatggatgctttacagtagtcttattattaaagggtgattaatttggtcggggtaaaatgttaatttttaggtgatttttaagaattctgtgccattatgtcttctgtgtggatggttaattgtttaattagtacgtgttaattgtgtgatacagtcttctttgtggaacccaaaatcctctttttagctttatattttataaactgccagattgtacaacttttatgtgcatttttaaagcttgaagacatgagggtcattatctaagttaaacagcctatttttgtgcctcctgtacagttttataattctgctgatggcggcatcttatgtcgagccaaccacaataaaggtagttttagaaaaaaaaaaaa

SEQ ID NO: 429862 - DNA, 2804 bp, Homo sapiens
cctggtgaactcagagattccattcagtattaagaatgggattgttgaattttactcacagagaaatcactgtttcttcatgttgtaagatgttttctgtttgtgtatttgtatcatggttactcatcaaaagctctcattctgcctttgtagaattcagttcccttcctttcatcatagctaaagtgacttttttccctactattaacgtgatcctacatccttaaatctcatcgattacctcacttaggccttggaaccttggcccttggtcggtgtccttggtgtcttctaagcaaggctgtgcgttgttcagaaacgtggccagaccgcatttcctgctgctcccatgccgcatgccaggtggcctgagacagagctccccatacggctgcaaggtgctttacctgtgggctttggcagtaacccaagagaggatcagaaggtggagaaggtgccacgagtgatttaacaggcctgccacagggagtgccccccgcccagctcgttctcagcacaggttttctctttgggagtacccaggtgatttctagtgacccaattttgtgtcatctccctgttttagccccacttgcctagagacaactgtttccgatgccttttctgcttatcatactagtttctaaccacgcagatttctcaaaatcatttattcaatgtattttatttgagcacttagtgtattgagctaggcaggatatagggtgccggagatacagcgatgaacaagacaggcaaaacttctgctttcctaaaacttgtgatgagagagaacaataaaaaagtgttgctgccacaaagaaaccaaagtgtgtggggaagggcgcgtgtttgcggttacatctcttctgtcccagaatcacagggatctggtccggtcacctctggtctttcctcttagtcgcctttaggagccctggttcccgtccatcctctggggggtttgtttgaagagatctcgtgtgggtacttgtcatgaaaacaccttgggcatcatctggtgtatccagttctagtctcgagaattctggtttcccactgtgctcagcaagtggaaagttcttttcaggccagaacagctctgcaccatcacatatcgtgttgcggcttagctgtttggtctgtagttcaggttatgggacttctccaatcctggaaggctgttgagctttttagaagtactgtacgctatcttcaagatggagcttggtcacatctgttaggaatccaaaggacactatgacttatttaaatcttgtcttactaaacctctcttgggcacgtgtgccagaatttctcttgttgcttcttgagtctttttaatttcagtgttttttcgtttgttttttgtttttttgagacagagtctcgctctgtcacccaggctggagtgcagtggcacgacctcagctcactgcaacctccgcctccttggttcaagcaattctcctgcctcagcctcccgagtagctgggattacaggtgtgtgccaccacgctcggctaattttttatattttttttagtagagacggggtttccccatgttaggcaggatggtctcgatctcctaacctcgtgatccgcctgcctcagcctcccaaagtgctgggattacaggcttgagccaccgcacccggcctaatctcagtttttgaagtgctccacaagtcattaggcaccaaaacattttcacctggggaacactggcatttccctgattagctgtgaagcaatctagtggctaagtgtgaaatcctgggtgcgcaggtgttctcactcccgccgtgttctcagtgcagtggtggtcagaggcccttccaaggagacatcactctgatcagttacagatagatgttctggaagatctgcaggtgagtagatccagcagagtttcttcccaccaactctagaagaaagggccttatcagagttgaccctgagcctttggtaaggttttgtgtgcatgcgattcagttatctttggcaattcttttcttgctgcagtgagagattaattggttgctgatcaaaccgttcatgcagatggggggacctttggattgtacggctttctcctcttggctgctttcttttcaggaagttggactttggccaggtttggctttcccagagccgttcctttctctgtcctttccttgggtcctcatggtgtgcccattggatccttggccttgtgatcctctgggaactgggggccagttccacttttgcagccttctgtgctggaagagaagcccagcgccctggaaggagcctctttaagtcccccatgtcgctttctctctctgctcttttagtgtctgagattgcctttctttgaatttcccagtgtttcttttccttgtcccttccctcaccaacctggagttattttggttgactatgtcctggctttggcttctcctggcaggaagtcatcaggcatcctctccaggtgagccgaaattccaccctcccaggttggacatcatcttttaaacccaatggtctactcccctccttctttatgaaacagtgatttcccgtgagtaactctggttctgattttttgtaccggcgcttaaattctttctgtagacgttggaaagccacaaagaacgtgactgcagtgagcctcccactggagcagccttaaccaacacttggcatccagagacactttgcatccagagacactttgcatccagagacactttgcatccagagacattttgcatccagagacactttgcatccagagacactttgcatccagaggac

SEQ ID NO: 429863 - DNA, 783 bp, Homo sapiens
  misc_feature (31)..(32): n is a, c, g, or t
  misc_feature (230)..(230): n is a, c, g, or t
gtagcccagaggtcctttatttttttttttnngcacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagagngcttaatgtgctcaatacgcacattaattctcttggcaagaatcttgcccttaacttgtttgtttacaacaatgccaacagcatgctgggtaaccttgcttaaagcacatcagatttgttttggacaacacccttgaccattttaaaactggaaaagtgatactgtatccttccatgggatggatgctttacagtagtcttattattaaagggtgattaatttggtcggggtaaaatgttaatttttaggtgatttttaagaattctgtgccattatgtcttctgtgtggatggttaattgtttaattagtacgtgttaattgtgtgatacagtcttctttgtggaacccaaaatcctctttttagctttatattttataaactgccagattgtacaacttttatgtgcatttttaaagcttgaagacatgagggtcattatctaagttaaacagcctatttttgtgcctcctgtacagttttataattctgctgatggcggcatcttatgtcgagccaaccacaataaaggtagttttagaaaaaaaaaaaa

SEQ ID NO: 429864 - DNA, 1496 bp, Homo sapiens
gaaaacaatcaggccaggtgcggtggttcctacctataatcccagcacttcaggaggtcaaggtgggtggatcacttgagcccaagagtttgagaccagcctgggcaacatagtaagaccctgcctgtactaaaaattttaaaaagcattagctgggcatggtggctggtacctgtagtcccaggctgacgtaggaggatagctcgagcctgggaggtggaggttgcagtgaaccatgatagtgccactgcactgaagcctgagcaacagagcgagaccctgtctccaaaaaaaaaaaaaaaaaaaaggacgtacgaggaagaggttgtgaagctatacataagacaattggcaatcttgtatttcacaagaatctaattagagaatttgggtggccaatcccctcagcatagtaagggagtcaaggaagcttttaagaacctcatcagttttctaccttccctgaacaagtgtctcttatttgtaactaaatttgtcagcttaacagtaagcagtaactggtattagactcaatttttcaactagatttgtaatttggcacagtaatgaaatcttaagcccatgcacctattctgggcttcttgtttgtttgttttgagacggagctaggctgcatgcagctgggaatggagtggcacaatcttggctcactgcaacctctgcctcccgggttcaggcggttctcttgcctcagcctcccgaatagctgggattgcgggcacacaccgccatgcccagctaatttttgtatttttagtagagatggggtttcgccgtgttggccaggctggtctccaactcctgacctcaagtgatccgcctgcctcggcctcccaaagtgctgggattacaggcgtgagccacttgtgccttgccacctattctgttttgaacttcattttcctaacaacatcctgaattactgagcttttgtatcacttcatgttaaagttttcattcttatgtaccaaagtactaatttgaatttgtaatgagtctgatggtatatttcaattttttgctttgagggactggctgctacattgcagaatatcttatatccctgactgctttccactaaatgtcagtggtgaccccaatccaattattatgacaactgaacatgcttatgcatccctcatgcctttattttttattttgggaaatctttcagcttcagtttttgctgatatttatgtgattctttgttctgcaattcaaatttctgggagccaaacagtctccttggttcagattactgttttttgactagagcttctcacttcagattctgtcataagattatggcttaacctatggttgtcctttgatttggtgccatatgaaataaaacattattttctatggctatgtattaagaattttgtgcaattctgtttttcttagaaggctgagggtgtgttgtcagacaccatgactgatgtgacaggtgtattttattatgcggccgccag

SEQ ID NO: 429865 - DNA, 874 bp, Homo sapiens
gcttgggaatctattcaacttggcattataccaaagcagtggcatactggcattccctagaggttctggaatagtatagaatgtgttaacgaaataaagacttaacgttttctgattaaaattactactattgatccctaaatttatagcagtgtgtactgttcttatatttaagtatatactgtgcttaatatttttgtcgtgtttaaattgatgaaggccagttgtggctcacgcgtgctgggattacaggcgtgagccacttgtgccttgccacctattctgttttgaacttcattttcctaacaacatcctgaattactgagcttttgtatcacttcatgttaaagttttcattcttatgtaccaaagtactaatttgaatttgtaatgagtctgatggtatatttcaattttttgctttgagggactggctgctacattgcagaatatcttatatccctgactgctttccactaaatgtcagtggtgaccccaatccaattattatgacaactgaacatgcttatgcatccctcatgcctttattttttattttgggaaatctttcagcttcagtttttgctgatatttatgtgattctttgttctgcaattcaaatttctgggagccaaacagtctccttggttcagattactgttttttgactagagcttctcacttcagattctgtcataagattatggcttaacctatggttgtcctttgatttggtgccatatgaaataaaacattattttctatggctatgtattaagaattttgtgcaattctgtttttcttagaaggctgagggtgtgttgtcagacaccatgactgatgtgacaggtgtattttattatgcggccgccag

SEQ ID NO: 429866 - DNA, 711 bp, Homo sapiens
agaatgaaaatactccacctccggcctcaattttttccttactaatccagcactgtcttaatgggggactttatcgatgccttaaaggaacccccgccacttgtgccttgccacctattctgttttgaacttcattttcctaacaacatcctgaattactgagcttttgtatcacttcatgttaaagttttcattcttatgtaccaaagtactaatttgaatttgtaatgagtctgatggtatatttcaattttttgctttgagggactggctgctacattgcagaatatcttatatccctgactgctttccactaaatgtcagtggtgaccccaatccaattattatgacaactgaacatgcttatgcatccctcatgcctttattttttattttgggaaatctttcagcttcagtttttgctgatatttatgtgattctttgttctgcaattcaaatttctgggagccaaacagtctccttggttcagattactgttttttgactagagcttctcacttcagattctgtcataagattatggcttaacctatggttgtcctttgatttggtgccatatgaaataaaacattattttctatggctatgtattaagaattttgtgcaattctgtttttcttagaaggctgagggtgtgttgtcagacaccatgactgatgtgacaggtgtattttattatgcggccgccag

SEQ ID NO: 429867 - DNA, 717 bp, Homo sapiens
tgtcctgctcatgccttccttggggatggccgtccaaccctccccacctggacatccatttttgttgatgaagatgacacctgctgggattacaggcgtgagccacttgtgccttgccacctattctgttttgaacttcattttcctaacaacatcctgaattactgagcttttgtatcacttcatgttaaagttttcattcttatgtaccaaagtactaatttgaatttgtaatgagtctgatggtatatttcaattttttgctttgagggactggctgctacattgcagaatatcttatatccctgactgctttccactaaatgtcagtggtgaccccaatccaattattatgacaactgaacatgcttatgcatccctcatgcctttattttttattttgggaaatctttcagcttcagtttttgctgatatttatgtgattctttgttctgcaattcaaatttctgggagccaaacagtctccttggttcagattactgttttttgactagagcttctcacttcagattctgtcataagattatggcttaacctatggttgtcctttgatttggtgccatatgaaataaaacattattttctatggctatgtattaagaattttgtgcaattctgtttttcttagaaggctgagggtgtgttgtcagacaccatgactgatgtgacaggtgtattttattatgcggccgccag

SEQ ID NO: 429868 - DNA, 388 bp, Homo sapiens
cactccaccctcattataaggctttcagaaatcagactgtaaggcccaataccatggctctcaactacgtgatactaactccattctctgatgtttgaacactttgtcaaaatgctgggtttccaatgatgatcgtataatttgaggaaaatgctattacccttttagcgcttcatttgctccattgttgactcaatcacagtggcacctcctcacacaagtcctctatttccaccctgtgaaacaaacacaatttgatttagatcgaagcatgataggcaaagttgagaaagttggttgaggtgcatgccttcttggggcaggtgcgattgcatccctgggacattatatgtctttacatctcccagctccatatagggcttagcca

SEQ ID NO: 429869 - DNA, 2084 bp, Homo sapiens
gttaacatcatatgatctatatggtagaaggaagaataacaaatgatgaatatagtgaatcatacctctagcagggtatagggacagaaccatccaagcataattattttcttggtgtgtttgaaacagttttttgaagcaaagtatatcaatatatagggatatattcaatattatgtatttcagatgcttaagtataaagctgtgtatgaaagtgtgtttgtcaggggaacaatattattattaacatacacttgaagatacattttgaaaataattgcaatctgcataattatttatctccagtgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtgcaggcttttttttttttttctttttttcttttttttgatacggagtttcattctgtcaccaggctggagttcagtg

SEQ ID NO: 429870 - DNA, 2060 bp, Homo sapiens
cagaattgaatcaacagcttctgctcccacccccctcaattctttggctctaataatgatcctgtttttgtattttcttcacattggtgctgatacaagctaaaaatatctgtatctccatatttatggtggatcactatgaaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtgcaggcttttttttttttttctttttttcttttttttgatacggagtttcattctgtcaccaggctggagttcagtg

SEQ ID NO: 429871 - DNA, 1826 bp, Homo sapiens
  misc_feature (13)..(13): n is a, c, g, or t
ctcggtaccgganttcctggtgtgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtgcaggcttttttttttttttctttttttcttttttttgatacggagtttcattctgtcaccaggctggagttcagtg

SEQ ID NO: 429872 - DNA, 1853 bp, Homo sapiens
gttaacatcatatgatctatatggtagaaggaagaataacaaatgatgaatatagtgaatcatacctctagcagggtatagggacagaaccatccaagcataattattttcttggtgtgtttgaaacagttttttgaagcaaagtatatcaatatatagggatatattcaatattatgtatttcagatgcttaagtataaagctgtgtatgaaagtgtgtttgtcaggggaacaatattattattaacatacacttgaagatacattttgaaaataattgcaatctgcataattatttatctccagtgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatatta

SEQ ID NO: 429873 - DNA, 344 bp, Homo sapiens
atattagaaaaatgagggtatcgtatttgtgtttttgtttgttcgtgttcattttaaagatagaatttgatttgagagcaaatttcatatatttttgtctgaattatgtgattattgaatgtttgatagcaattaagtgtcactatataaatgtaattttctttttttaaaaaacagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagt

SEQ ID NO: 429874 - DNA, 516 bp, Homo sapiens
gcctgatcaaccccgtataaccaaagatgtaatttgttttcatgctgaagatttcttagaagtagttcaacgaatgcagttagatttacatgaacctccactgtcccaggtatttttaatacacttactgtctttggtttagtttttattatgaagagagttatttgtatttcttgttttattattttttagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaa

SEQ ID NO: 429875 - DNA, 2064 bp, Homo sapiens
gccggaggtgtccggcgggctgagttccggtttatcgctggtctgcccacacctatacggcagtgtaccaccacggggctagagggtgcgggggagcgcatcgcgaaaaagtatctgtatctccatattatggtggatcactatgaaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtgcaggcttttttttttttttctttttttcttttttttgatacggagtttcattctgtcaccaggctggagttcagtg

SEQ ID NO: 429876 - DNA, 1722 bp, Homo sapiens
  misc_feature (13)..(13): n is a, c, g, or t
ctcggtaccgganttcctggtgtgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtgcaggcttttttttttttttctttttttcttttttttgatacggagtttcattctgtcaccaggctggagttcagtg

SEQ ID NO: 429877 - DNA, 924 bp, Homo sapiens
gagatctcttttgtaatatggatattgaaattaccttgtttcttggttttgttttttgtttcctcttgcctagatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaaaaa

SEQ ID NO: 429878 - DNA, 491 bp, Homo sapiens
cggctacatagctgtgactaccagggggtgcagtctctggggaccaccactaccgaggctgggtaccatgattatcgcggaacacctgcccattaatcttgaccctgttaaaacaataactgcctatccagatatgccacacttctgcctgctgttggcaaccctcctggactaggctgctcttgttaatcacatggatgttgctgattactctgagtgcaaaccttttcactgttccagagaggagcctgacaaccacattctccttctcaagatgtgaaaggcattgtacagaagaagatgagaatcacagtaaaccaaacaaaggaaatgcagaagagatattttcagctgaatattggaaagtaagattccctgcgagcaggatctcaggcaacgtcaatgaacaacatgaagcctgacacattgtaggtgccccgtaaatattggttgagtaactgaataaacgtatttagtaacttaaaaaagct

SEQ ID NO: 429879 - DNA, 1308 bp, Homo sapiens
ctctgctggagcaggacttcagagtgtttgttttcagcctgcttttaaagtgatttgaagagagcggctttgaagattatcgcggaacacctgcccattaatcttgaccctgttaaaacaataactgcctatccagatatgccacacttctgcctgctgttggcaaccctcctggactaggctgctcttgttaatcacatggatgttatataaagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaaaaa

SEQ ID NO: 429880 - DNA, 1510 bp, Homo sapiens
ttcacttcctgagccgggctggctgggtgggaacaggctccttgccgcctccccagcgctggccactaccacactgccgcccgcctgggcctcctttcaacctcgtggtggagccctgcggtttcccagcggagccgggcccggggctgctccctcgcgggcgaggctcacctgtcccggcccggccccctcccgcgccccaggtggttcagggcagggaggagccgcgccccgccccgcgcggtagcagccaacgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttatataaagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaaaaa

SEQ ID NO: 429881 - DNA, 1165 bp, Homo sapiens
  misc_feature (56)..(56): n is a, c, g, or t
tagatcttttatatacaatttcgtccgcggccggagaagaacaaaaaaaggctgantataaagcatataaagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaaaaa

SEQ ID NO: 429882 - DNA, 1582 bp, Homo sapiens
ttcacttcctgagccgggctggctgggtgggaacaggctccttgccgcctccccagcgctggccactaccacactgccgcccgcctgggcctcctttcaacctcgtggtggagccctgcggtttcccagcggagccgggcccggggctgctccctcgcgggcgaggctcacctgtcccggcccggccccctcccgcgccccaggtggttcagggcagggaggagccgcgccccgccccgcgcggtagcagccaacgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttgctgattactctgagtgcaaaccttttcactgttccagagaggagcctgacaaccacattctccttctcaagatataaagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaaaaa

SEQ ID NO: 429883 - DNA, 1759 bp, Homo sapiens
ttcacttcctgagccgggctggctgggtgggaacaggctccttgccgcctccccagcgctggccactaccacactgccgcccgcctgggcctcctttcaacctcgtggtggagccctgcggtttcccagcggagccgggcccggggctgctccctcgcgggcgaggctcacctgtcccggcccggccccctcccgcgccccaggtggttcagggcagggaggagccgcgccccgccccgcgcggtagcagccaacgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttgctgattactctgagtgcaaaccttttcactgttccagagaggagcctgacaaccacattctccttctcaagatataaagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccacaagtaaaacgtctttgatatactttattagagagtgattcttataaataaaaaattatttggtatacatgtgggtacctgtagttcccacgcctggaagagtatcagaatcatgatgaaaggatttttaactgcatatccctaatcacttctccagagatttaacagtcaagaggctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaaaaa

SEQ ID NO: 429884 - DNA, 545 bp, Homo sapiens
ccagaacattaaaaataaggaaaataacacactttgggcttattttcttatagagttatcaattaataaaaggcgattggaattacatggtattttattttcaattacagcttgccacagctaccttggatggtaaactccagctctttctagctgagtaaccactgacctgtgagctgggtccaggaatgctgtgaggaacaacttaaaagtaagaagtagtggttcatccatcagggggccagaagcagcaactgtttttcatattttgagacttgcctcagatttcccccgtttgcaagctcctcccctctgtgtgtgccatgtcagagttttatgtctttctgctcctcaaaagggatccccttcattgggaaaatggaaatggcgtccagtacttctgcacagaatttggtaaagttaaaacaaaatatctttcaataaaacataatatagtatttgtttgataattagagttggaagaaaaaagagagaatttcttttgggcagtgaaaataaagcagttaacagtcctaaaaaaaaat

SEQ ID NO: 429885 - DNA, 478 bp, Homo sapiens
gtccacctgctcttgccaacacctggagtcagatggggtggggctggactggactcaggacttttcctgcggcatttcagaaattcttaactagtcatccattcatgagtcttctaatattccaaagtttttattagtaaaagagagggaactgtcccttccccatgggtaagagtgttgagaagagctccctaactggattatcgcagacatcgtactcgcagctggccggaacaggaccgtggaagtgtttgacctcaacgccggctgcagtgcacggtgatagcggaagcccactcacggcctgtccatcaaatctgccaaaataaagtgagtaagtttttggataacatgtatcatctgtaaaactatgtgcttaaagcatttaacagatacaaatgtatgatgccattttataagtgtttgctaccaaattcaatgttaatttttattgatcattaaattattcgaagccttg

SEQ ID NO: 429886 - DNA, 1075 bp, Homo sapiens
gtcacgacggggcagtgaatgccgtgtgctggagccaggaccggagtggctgctctctgcggcccgggacggacccatgcgaatgtggtcggctcgtggggcagagctcgcactgcttctgatataaacagaagagcaagtccaagctgatttgcaggctctccacgacgggtgcagtagacatgaccagtttatcggcagtcaacgacttttattcccacatcgtactcgcagctggccggaacaggaccgtggaagtgtttgacctcaacgccggctgcagtgcacggtgatagcggaagcccactcacggcctgtccatcaaatctgccaaaataaaggttcatcatttacaacccaacagcctcaggcttataaccttttcctgaccacggccattggcgatgggatgagactgtgggacctgagaaccctgaggtgtgagcgccactttgaagggcatccaacccgcggctatccatgtggaatcgctttcagtccttgtggacgattcgcggcttgtggggccgaggacagacacgcttacgtgtatgaaatgggctcaagcacgttttctcaccggctggctgggcacacagacactgtcactggagtggccttcaacccatcagcgccccagcttgccacagctaccttggatggtaaactccagctctttctagctgagtaaccactgacctgtgagctgggtccaggaatgctgtgaggaacaacttaaaagtaagaagtagtggttcatccatcagggggccagaagcagcaactgtttttcatattttgagacttgcctcagatttcccccgtttgcaagctcctcccctctgtgtgtgccatgtcagagttttatgtctttctgctcctcaaaagggatccccttcattgggaaaatggaaatggcgtccagtacttctgcacagaatttggtaaagttaaaacaaaatatctttcaataaaacataatatagtatttgtttgataattagagttggaagaaaaaagagagaatttcttttgggcagtgaaaataaagcagttaacagtcctaaaaaaaaat

SEQ ID NO: 429887 - DNA, 826 bp, Homo sapiens
agcaacctccagcatgggtgtcatagccatcacgagcatgtcacagtgccgcagagattttgtttatgggcagtttctcatggcctgtttatgtccaaatttggggggcctgttctgagcacattttcctgtaagcactcaggaagaatgaagcttcctgtgtcctttaacactttaagtacagatcttagtgatacataaccagttttatctctctcaagctctaccttccgcaaagtgctagaatacagttctgccaagttcttcactacttcgtatcaagggttgtattttctttatttcccaatagcatgttcctcattccccaatgacacctcaccaggatcacccttaccaaccttacttccagcttgcacatcagaatttttccagcctcatttgtcagtttcaaatctgcttcacatttttagtttttttgtttgtttgtttttaatctgccttaatgagctcaggccactatcacaaaataccacagaccaaatggcttacaaatttgttaattttaaataaatgaggttaaaaacaaatttatattctcacatttctcgaggctggaagtctgagatcagagtgccagcatggtcaacttctggcgagagctctcttcctggtatgtaaatgcccacttcctcatgtcttcacaggaaggaaaccaacaaataggtctctctctcctctctcctttctcctctctcctctctcctctttctctctctctccccaccatctctctccttcccctccctccccctccctccccctacccatctcttgacatcatttcacgatacttctaaagagccta

SEQ ID NO: 429888 - DNA, 2369 bp, Homo sapiens
  misc_feature (2347)..(2347): n is a, c, g, or t
gggccggaaagcggaagcggcgtgcaacacgtgggggcggtgccggtcggagggctcctagtgcgccaggttgtgggaagtgaggctggcggtggcgacaaccgaggaggaggggcgggacgccgtggagcacggcgaccggctgagcgtcatggagggctcaggggagcagccgggcccacaaccacagcatcccggagaccaccgcatccgcgacggcgacttcgtggtgctgaaacgtgaagatgtgtttaaagcagtacaagtccagcggagaaaaaaagtaactttcgaaaaacagtggttctacctggataacgtcattggccatagttatggaactgcatttgaagtgaccagtggaggaagtctacagcccaagaagaagagggaagagcctactgcagagactaaagaagcgggcactgataatcgaaatatagttgatgatgggaaatctcagaaacttactcaagatgacataaaagctttgaaggacaagggcattaaaggagaggaaatagttcagcagttaattgaaaatagtacaacattccgagacaagacagaatttgcccaagataaatatattaaaaagaagaaaaaaaaatatgaagccatcattactgttgtgaagccatccacccgtattctttcaattatgtattatgcaagagaacctggaaaaattaaccacatgagatacgatacactagcccagatgttgacgttgggaaatatccgtgctggcaacaaaatgattgtgatggaaacgtgtgcaggcttggtgctgggtgcaatgatggaacgaatgggaggttttggctccattattcagctataccctggaggaggacctgttcgggcagcaacagcatgttttggatttcccaaatcttttctcagtggtctttatgaattccctctcaacaaagtggacagtcttctacatggaacattttctgccaagatgttatcttcagagccaaaagacagtgctttggttgaagaaagtaatggcacactggaggaaaaacaggcttctgaacaagagaatgaagacagcatggcagaggccccagagagcaaccacccagaagaccaggaaacaatggaaacaatttctcaagatccagaacataaggggcctaaagagagaggaagcaaaaaagattatattcaggaaaaacagaggagacaagaagagcagaggaaaagacatttagaggctgccgctctgctgagtgaaagaaacgcagatggtttaattgtagctagtcgtttccaccccactcccctgctgctgtctttgctggactttgtggccccttcaaggccgtttgtggtctactgtcagtacaaagagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttaaagcagacaccagcctcaaatctaatgcaagcactttagaatcacacgagactgaggagcctgcagctaaaaaacgaaaatgcccagagtctgactcttaacccttttgagaattgctctgaattttgttctcaggcattatacagttagtaattaaactttaaatgccattactacttgttttttcatatcccaagaataagaacatgtctatgtacccgtttctaggaaggaggagtatatgccttttgtctatttctgacacagatgcatttggtctgtcaaaactgcaaccatggggtatgtagtatgaccaactgcatttaacaaaactcctctaagtacttctaaatattctgtgcaaatatcttgagaacttcaacatcctaaaaatgtgtttctacaagactttatattttaagctaagtggaataatacaacgtaactaaaacatggcgggtaccgaaaggagggcaattcatggaagaaatttcctctgttcattccgttctcttcaacctaagcaatatggatgtgtgagtgtgtgatttattatggtaccaaaaatgtccaccttctttcctgcagcggaataagcttttttgaaatgctgaggttttattttaatagttgacaacctgggaaagttctgagtatttattttactgctcttttttgtgcatagaaaggtttagtagggtacttttttgcattaatttgccaatactcttattctttgttctaaataaagtgactagaatttttgtgtactattcaattaaaggaaacaaatgtcttttaanaaaaaaaaatgcctttggctaa

SEQ ID NO: 429889 - DNA, 2259 bp, Homo sapiens
  misc_feature (2237)..(2237): n is a, c, g, or t
gggccggaaagcggaagcggcgtgcaacacgtgggggcggtgccggtcggagggctcctagtgcgccaggttgtgggaagtgaggctggcggtggcgacaaccgaggaggaggggcgggacgccgtggagcacggcgaccggctgagcgtcatggagggctcaggggagcagccgggcccacaaccacagcatcccggagaccaccgcatccgcgacggcgacttcgtggtgctgaaacgtgaagatgtgtttaaagcagtacaagtccagcggagaaaaaaagtaactttcgaaaaacagtggttctacctggataacgtcattggccatagttatggaactgcatttgaagtgaccagtggaggaagtctacagcccaagaagaagagggaagagcctactgcaggaaatagttcagcagttaattgaaaatagtacaacattccgagacaagacagaatttgcccaagataaatatattaaaaagaagaaaaaaaaatatgaagccatcattactgttgtgaagccatccacccgtattctttcaattatgtattatgcaagagaacctggaaaaattaaccacatgagatacgatacactagcccagatgttgacgttgggaaatatccgtgctggcaacaaaatgattgtgatggaaacgtgtgcaggcttggtgctgggtgcaatgatggaacgaatgggaggttttggctccattattcagctataccctggaggaggacctgttcgggcagcaacagcatgttttggatttcccaaatcttttctcagtggtctttatgaattccctctcaacaaagtggacagtcttctacatggaacattttctgccaagatgttatcttcagagccaaaagacagtgctttggttgaagaaagtaatggcacactggaggaaaaacaggcttctgaacaagagaatgaagacagcatggcagaggccccagagagcaaccacccagaagaccaggaaacaatggaaacaatttctcaagatccagaacataaggggcctaaagagagaggaagcaaaaaagattatattcaggaaaaacagaggagacaagaagagcagaggaaaagacatttagaggctgccgctctgctgagtgaaagaaacgcagatggtttaattgtagctagtcgtttccaccccactcccctgctgctgtctttgctggactttgtggccccttcaaggccgtttgtggtctactgtcagtacaaagagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttaaagcagacaccagcctcaaatctaatgcaagcactttagaatcacacgagactgaggagcctgcagctaaaaaacgaaaatgcccagagtctgactcttaacccttttgagaattgctctgaattttgttctcaggcattatacagttagtaattaaactttaaatgccattactacttgttttttcatatcccaagaataagaacatgtctatgtacccgtttctaggaaggaggagtatatgccttttgtctatttctgacacagatgcatttggtctgtcaaaactgcaaccatggggtatgtagtatgaccaactgcatttaacaaaactcctctaagtacttctaaatattctgtgcaaatatcttgagaacttcaacatcctaaaaatgtgtttctacaagactttatattttaagctaagtggaataatacaacgtaactaaaacatggcgggtaccgaaaggagggcaattcatggaagaaatttcctctgttcattccgttctcttcaacctaagcaatatggatgtgtgagtgtgtgatttattatggtaccaaaaatgtccaccttctttcctgcagcggaataagcttttttgaaatgctgaggttttattttaatagttgacaacctgggaaagttctgagtatttattttactgctcttttttgtgcatagaaaggtttagtagggtacttttttgcattaatttgccaatactcttattctttgttctaaataaagtgactagaatttttgtgtactattcaattaaaggaaacaaatgtcttttaanaaaaaaaaatgcctttggctaa

SEQ ID NO: 429890 - DNA, 3076 bp, Homo sapiens
  misc_feature (3054)..(3054): n is a, c, g, or t
gggccggaaagcggaagcggcgtgcaacacgtgggggcggtgccggtcggagggctcctagtgcgccaggttgtgggaagtgaggctggcggtggcgacaaccgaggaggaggggcgggacgccgtggagcacggcgaccggctgagcgtcatggagggctcaggggagcagccgggcccacaaccacagcatcccggagaccaccgcatccgcgacggcgacttcgtggtgctgaaacgtgaagatgtgtttaaagcagtacaagtccagcggagaaaaaaagtaactttcgaaaaacagtggttctacctggataacgtcattggccatagttatggaactgcatttgaagtgaccagtggaggaagtctacagcccaagaagaagagggaagagcctactgcagagactaaagaagcgggcactgataatcgaaatatagttgatgatgggaaatctcagaaacttactcaagatgacataaaagctttgaaggacaagggcattaaaggagaggaaatagttcagcagttaattgaaaatagtacaacattccgagacaagacagaatttgcccaagataaatatattaaaaagaagaaaaaaaaatatgaagccatcattactgttgtgaagccatccacccgtattctttcaattatgtattatgcaagagaacctggaaaaattaaccacatgagatacgatacactagcccagatgttgacgttgggaaatatccgtgctggcaacaaaatgattgtgatggaaacgtgtgcaggcttggtgctgggtgcaatgatggaacgaatgggaggttttggctccattattcagctataccctggaggaggacctgttcgggcagcaacagcatgttttggatttcccaaatcttttctcagtggtctttatgaattccctctcaacaaagtggacagtcttctacatggaacattttctgccaagatgttatcttcagagccaaaagacagtgctttggttgaagaaagtaatggcacactggaggaaaaacaggcttctgaacaagagaatgaagacagcatggcagaggccccagagagcaaccacccagaagaccaggaaacaatggaaacaatttctcaagatccagaacataaggggcctaaagagagaggaagcaaaaaagattatattcaggaaaaacagaggagacaagaagagcagaggaaaagacatttagaggctgccgctctgctgagtgaaagaaacgcagatgggtgcgttgatggaagaaggcaggagactcctcagtgcatgtgggctctgcttcagacagattggcattctctttctccttgtctgctttgactctagtgggacccgagatgaggatttgtcttgggggtttttttaaagaaaggaggctgaggctggcaggggtggggaattgatgatgctggtttcagggtttcagaagaaattgaatcttctccatcactgcatcaagatgggccctgtggtcccactggatgcaggggatggggcactcaaatgctgcgatacaggctataacagatatccacaaagcagcttatgcagtgttggatttgtttccaggtgattttttttaaaaaatcaagaatgtcattaaatgcgacttagagttgccaagtaccacaagagcttctaacctagttcgcgtttcctagaaagaaatagctcatgattgtattctgttttggatttctagaatgttatatttaaatctcttctctttgtgagtcatgcaaattaaatacatgatcattttaaatgcattttaaaacctgtgctccactttgagggtgtagagaaataatttgtctggcattttccttacagtttaattgtagctagtcgtttccaccccactcccctgctgctgtctttgctggactttgtggccccttcaaggccgtttgtggtctactgtcagtacaaagaggtaatactggaatggaatgggcaggaattcttatgtctgaatgttgattcttaaactgcatcccaggaagtagttcttaacagaattctgttgttgtctgcagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttaaagcagacaccagcctcaaatctaatgcaagcactttagaatcacacgagactgaggagcctgcagctaaaaaacgaaaatgcccagagtctgactcttaacccttttgagaattgctctgaattttgttctcaggcattatacagttagtaattaaactttaaatgccattactacttgttttttcatatcccaagaataagaacatgtctatgtacccgtttctaggaaggaggagtatatgccttttgtctatttctgacacagatgcatttggtctgtcaaaactgcaaccatggggtatgtagtatgaccaactgcatttaacaaaactcctctaagtacttctaaatattctgtgcaaatatcttgagaacttcaacatcctaaaaatgtgtttctacaagactttatattttaagctaagtggaataatacaacgtaactaaaacatggcgggtaccgaaaggagggcaattcatggaagaaatttcctctgttcattccgttctcttcaacctaagcaatatggatgtgtgagtgtgtgatttattatggtaccaaaaatgtccaccttctttcctgcagcggaataagcttttttgaaatgctgaggttttattttaatagttgacaacctgggaaagttctgagtatttattttactgctcttttttgtgcatagaaaggtttagtagggtacttttttgcattaatttgccaatactcttattctttgttctaaataaagtgactagaatttttgtgtactattcaattaaaggaaacaaatgtcttttaanaaaaaaaaatgcctttggctaa

SEQ ID NO: 429891 - DNA, 986 bp, Homo sapiens
ccctacatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggta

SEQ ID NO: 429892 - DNA, 2704 bp, Homo sapiens
ccctacatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaaatgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatca

SEQ ID NO: 429893 - DNA, 986 bp, Homo sapiens
cgcaggttctatagaatttgccaagactgctggcctgttttctaccctgattccttaggtggcttctgggacagaattacggttctctaagtatttgcttgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggta

SEQ ID NO: 429894 - DNA, 2646 bp, Homo sapiens
ccctacatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacactaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaaatgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatca

SEQ ID NO: 429895 - DNA, 3508 bp, Homo sapiens
ccctacatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaaatgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcagtttgtagtcttgcttttgtattcatgttgataatcttactaattgtgaagttgattcactactatactaggtaagacctaagtgaaacagttcctgtttttccttaatactgttttcagaattttgaaaatgtacttatatatacataaatactactaaaaaattaatgagcctggcaaaccattgatttataaaagtaagtgttctaagaggggaacaagacagttctgtgtgataaggaagttaggctccactttttgtttgaattaccctatgtatatccgaaggtaaacttaggcttttctttccaaaagatcgtatagtcaattcattctttttctcctatcacatctgggaaagtagctaacttttaactatttatgttcccataagtaacccttcttttgtgtgtatacatttccttttctctgacttgagatgtcaaatttggatttctagaacagtttctcagttaaattcttgatgacttaacaacttttactatcagaatacaattagaaatccttggtcaggcacaggggctcacgcctgtaatcccagcactttgggaagccaaggcagacagatcacctgaggtcaggagttcgagaccagcctgaccaacatggagaaaccctgtctctactaaaaatacaaaaattagccgggcgtggtgctactcgtgaggctgaggcaggagaatcgcttgaacccgggaggtggaggttgcggtgagctgagatcgtgccattgcactccagcctgggtaacgagcaaaactccgtctcaaaaactccgtctca

SEQ ID NO: 429896 - DNA, 3021 bp, Homo sapiens
ccctacatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaaatgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcaaaaaaaaaaaaaaaacgaacaccttgtgttggggcgcgacattggaccctcggagaaaaagtttctttctaaaaccccatttccggtgggggggccgcggggcgcccatgtgtatgttatctgtgaaacactggcgtcaaaacggtgggtacccaggaaaaacccgggcgcaccagcactactgctctggggtctccccccgtattaaaaaaacccgcggggggacacccccactgtttctggacaattaccaagtggggtctcgacgcgcctaccggtccttctcacacagcgttccccgcaggcagattaatacg

SEQ ID NO: 429897 - DNA, 2641 bp, Homo sapiens
ccctacatccgggtaccgactccagccgcctagacgctggcactatggtcatggcggaggggacggcagtgctgaggcggaacaggccgggcaccaaggcgcagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaaatgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatca

SEQ ID NO: 429898 - DNA, 2704 bp, Homo sapiens
cgcaggttctatagaatttgccaagactgctggcctgttttctaccctgattccttaggtggcttctgggacagaattacggttctctaagtatttgcttgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaaatgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatca

SEQ ID NO: 429899 - DNA, 2641 bp, Homo sapiens
cgcaggttctatagaatttgccaagactgctggcctgttttctaccctgattccttaggtggcttctgggacagaattacggttctctaagtatttgcttgcagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaaatgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatca

SEQ ID NO: 429900 - DNA, 2490 bp, Homo sapiens
ttttgggggcccctttggggtttccccccaaaaaaaaaaaccccttttttttcccaaaggggaaagggttgggaaaaatgggcccccccaatcccagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaaatgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatca

SEQ ID NO: 429901 - DNA, 394 bp, Homo sapiens
cgcaggttctatagaatttgccaagactgctggcctgttttctaccctgattccttaggtggcttctgggacagaattacggttctctaagtatttgcttgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggtaggaccttacatcaaaatactaatagtacctctcacaaaactagctttcatattaatgataattatgaattgtaaaatttactatgtaactgcagactaagaagccaaattttaaagctttggc

SEQ ID NO: 429902 - DNA, 175 bp, Homo sapiens
gcagttctgccttgagctaaatggacttgctgtcaaacttcaggtaatattttctttaagtcaaagttataattgaaagttctgatttttttttctctgtttttataacttaatgtgcttacaaaaacgtatccacatttctaactttcttctagaatttattatggaaatatag

SEQ ID NO: 429903 - DNA, 2849 bp, Homo sapiens
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagc

SEQ ID NO: 429904 - DNA, 4936 bp, Homo sapiens
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacggccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacaaaaacaacacaacaaaaaaaacaaaacttgttcggggcgcggggcccaaaaa

SEQ ID NO: 429905 - DNA, 3782 bp, Homo sapiens
gaaaagggagcgggtcagaaggcagcgcggcggcaagcagcgactctccttcgagaatttctttaattggggagccgaggcggcttttggtctccagcttttccccctgcattttcaccggggcaggattcttaggtctcagccctccttgtttccccaatcccctgttccctgtctgacgtcctttccctctggcccccgtctcccaagaccaaagccatcacttccactctgatccgtgttggctgctgctgctcattaatcccactgctcattgcccactcgtcctgctgcttgtttttttgctccactgctaccactctggagttagcctttgcccccctctggtgcttgcaatcagcccacagtgtatctgccacactagagctgcttccgatttgcagtctttccttccaccacatctgtcatcttaaagctgccccttaagtatctagattatgctcctcctgctaacccacctgtttctcagccttcttgagaattgtccgttccttccctctttcctgtacagatcctttcaatatacacttccagaaaaagggaagccccgtggtggcccttgaaaagtaaaaggaagttgggaagtgaatgaagtgaggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacggccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacaaaaacaacacaacaaaaaaaacaaaacttgttcggggcgcggggcccaaaaa

SEQ ID NO: 429906 - DNA, 4670 bp, Homo sapiens
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacggccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacaaaaacaacacaacaaaaaaaacaaaacttgttcggggcgcggggcccaaaaa

SEQ ID NO: 429907 - DNA, 1927 bp, Homo sapiens
attgatttacaaacccataatggtgaagaggctatagagagacaagaacctccctctcctgatccttgagcaagtttttcctcacttcaggggctctgagctcacgagcaaaatcctaaccaagtttatcttgctaggacaacccattttaaatgctcaataaagaaagaataattcttctcccgcttaaccactaaagaacaacatatgtttctaacgtagctttttatttttttttatctttcatttttttgttggtaaatctcccagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacggccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacaaaaacaacacaacaaaaaaaacaaaacttgttcggggcgcggggcccaaaaa

SEQ ID NO: 429908 - DNA, 1531 bp, Homo sapiens
attgatttacaaacccataatggtgaagaggctatagagagacaagaacctccctctcctgatccttgagcaagtttttcctcacttcaggggctctgagctcacgagcaaaatcctaaccaagtttatcttgctaggacaacccattttaaatgctcaataaagaaagaataattcttctcccgcttaaccactaaagaacaacatatgtttctaacgtagctttttatttttttttatctttcatttttttgttggtaaatctcccagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacaaaaacaacacaacaaaaaaaacaaaacttgttcggggcgcggggcccaaaaa

SEQ ID NO: 429909 - DNA, 3722 bp, Homo sapiens
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacacatttcaactcgggatcctcaagaataccatc

SEQ ID NO: 429910 - DNA, 2244 bp, Homo sapiens
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtaggttcatttaaaacctttgagaatttttgaataactcatattttcaggttgttgggtggatagggaagtaactgttgaataacagagtactaatatcttggaaatgtctatgaaagattagtctttatcataatctaaaatatatttttcattagatggatgccttgtaatattgagctttataaggatggtggagtattatacttagttattgtttggaagcattttacttaataggataattaccaaactttcatatggtatacaaatgcaaa

SEQ ID NO: 429911 - DNA, 618 bp, Homo sapiens
cactctgatccgtgttggctgctgctgctcattaatcccactgctcattgcccactcgtcctgctgcttgtttttttgctccactgctaccactctggagttagcctttgcccccctctggtgcttgcaatcagcccacagtgtatctgccacactagagctgcttccgatttgcagtctttccttccaccacatctgtcatcttaaagctgccccttaagtatctagattatgctcctcctgctaacccacctgtttctcagccttcttgagaattgtccgttccttccctctttcctgtacagatcctttcaatatacacttccagaaaaagggaagccccgtggtggcccttgaaaagtaaaaggaagttgggaagtgaatgaagtgaggtaggatactattaaacgttatgagtgaagatcttttattcaggctactccggagaggaccgttttcgttttgctttctgtgatctatttgtcgcttattcgctctgttgtgttaggacttggctttttttcttttttttcgttttggaccggttttatcatgctactaagcgttctttggattgcctctccccaggacacttagtgtgggccctgatttatacca

SEQ ID NO: 429912 - DNA, 3410 bp, Homo sapiens
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacggccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacaaaaacaacacaacaaaaaaaacaaaacttgttcggggcgcggggcccaaaaa

SEQ ID NO: 429913 - DNA, 3497 bp, Homo sapiens
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcggatcctttcaatatacacttccagaaaaagggaagccccgtggtggcccttgaaaagtaaaaggaagttgggaagtgaatgaagtgaggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacggccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacaaaaacaacacaacaaaaaaaacaaaacttgttcggggcgcggggcccaaaaa

SEQ ID NO: 429914 - DNA, 3623 bp, Homo sapiens
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacggccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacaaaaacaacacaacaaaaaaaacaaaacttgttcggggcgcggggcccaaaaa

SEQ ID NO: 429915 - DNA, 3791 bp, Homo sapiens
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaaggtatgctttaatttgttaaaaaaaaaagtatgaaaggggataatgtgaatacaaaaaagaagcctagagattgaaaataataataatagaacatgttattaggagatggtacttaatgtcatgttggagttggagttttcaaggttacctctatataaaattggattattttctgttagatataatgtgacaaattaaatgactttatcccaaggtacagtgaggtaaacaaaaatctattcttagatatccttagatttggttaactgaggctgtagaagcagcgaattgtctagccatttaagttatttttgtaaaattcagcataaacatcaatctctaatttctatctagaagtgactttaagacattacaagaacattgccaatttggaaaatgccaataaaatactgtagacttattaatattgtagacttattatcagtcttttactatagcttaatttaattatggttttcatttttactgtaagaggccaagacttcacttat

SEQ ID NO: 429916 - DNA, 2012 bp, Homo sapiens
  misc_feature (2000)..(2000): n is a, c, g, or t
cggatcagcgtgcgcctgcgcactgtggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagaccttacagagccaattgagaggaagagactggcagtgctgaagagaagataggctcattcagtaggataatagatgtcgttgggtggtgggaagagataagctcctgagacgagcatgtggtatagcttaagagaggtgggtggccaggcgcggtggctcacgcctgtaatcccaacactttgggaggccaaggcaggcagatcacaaggtcaggagatcgagaccatcctggctaacacggtgaaaccccgtctctactaaaaatacaaaaaaattagctgggcgtggtggcgggcacctgtagccccagctactcgggaggctgaggcaggagaatggcgcgaacccaggaggtggagcttgcagtgagccgagatggtgccactgtgctccagcctgggcaacagagngagactccgtct

SEQ ID NO: 429917 - DNA, 1173 bp, Homo sapiens
gaaaagggagcgggtcagaaggcagcgcggcggcaagcagcgactctccttcgagaatttctttaattggggagccgaggcggcttttggtctccagcttttccccctgcattttcaccggggcaggattcttaggtctcagccctccttgtttccccaatcccctgttccctgtctgacgtcctttccctctggcccccgtctcccaagaccaaagccatcacttccactctgatccgtgttggctgctgctgctcattaatcccactgctcattgcccactcgtcctgctgcttgtttttttgctccactgctaccactctggagttagcctttgcccccctctggtgcttgcaatcagcccacagtgtatctgccacactagagctgcttccgatttgcagtctttccttccaccacatctgtcatcttaaagctgccccttaagtatctagattatgctcctcctgctaacccacctgtttctcagccttcttgagaattgtccgttccttccctctttcctgtacagatcctttcaatatacacttccagaaaaagggaagccccgtggtggcccttgaaaagtaaaaggaagttgggaagtgaatgaagtgaggtaggatactattaaacgttatgagtgaagatcttttattcaggctactccggagaggaccgttttcgttttgctttctgtgatctatttgtcgcttattcgctctgttgtgttaggacttggctttttttcttttttttcgttttggaccggttttatcatgctactaagcgttctttggattgcctctccccaggacacttagtgtgggccctgatttataccaataaatattaaccccagcattacaaaataagataaatctggcgcacatacagaattcatctgtgaactccgctagcaaatataagtgatattttgattacatgtgggttatgtgtgggttctgtattgaggcttgatttttgactgagttttattgatgttcagcttaattgatgacattttatttatgatttgagtggaaatttcctctccagttaatatcagattttcttcttatttttggatttgggaagttctcttgacatttctaggatgatagttatcagaataaattgtcttgtcttgaaaatccattagttatgtatgca

SEQ ID NO: 429918 - DNA, 550 bp, Homo sapiens
tcccctgaagagcaatgggctacagatgttctctctgaggttccctctcatgcctataatcccagcactttgagaggctgaggccaggagttagaaaccagcctgggcaacacagtgagattctgcttgtacaaaaaactagccaggcatggtagtgcgcacttgtagtcccaactactcaggactaattaatccaaatttatccaattttgtctcctggagtaaagatcacttgagcccaggaattcaagactacaatgagctatgatcatgccattgcactccagcctgggcgacagagcaaaaccctgtcgctaaaggagaaaaaaaaattctctctgaaatactcaaactacctccaccaaagaccaaaaggttggcagtcaggatacccccacctcacatatccccaaccccaagaattacttcctagatatattctcacattatcatataagtctccaatataagagaaaacaagaattccagggaaggctttataaactaaatttgtgatccttttgtgactttgtaaactaaagtcaaggtg

SEQ ID NO: 429919 - DNA, 1115 bp, Homo sapiens
ctcagcctcccgagtagctgggattacaggcgcccgccaccatgcccaaataatttttgtatttctagtagaaatgaggtttcaccatgttggccaggtgaactcctgacctcaagtgatccactcaccttagcttcccaaagtactgggattataggcatgagccaccgcgcccagctgaaagtatatatactttctagtttgtgatatattctaaagtatatctaaaggttggtattttggcattttgaggtcccagaactgaaaacataaatagttttttttttcatatgaatgtaggtcctatgaatcacttttattaccgcagtgtggtgcataatcaaacaaggaggacttagttgtcttaaaaaattatttttgctttcatgttcagattggtatccagttgaaagtatttttcaacttcaaaaatgggaagtctgggcaacaaatgagatatttgtgggttgtaatacagtataaaattgtgattccatcttttaatcttacaaataacaattgttctatagatatgtgagtctttttaaaaaaaaatttttagcatcacttctcaaaaatgtgagcataccacattttgtttttatttttcttttgctctatgataaatttccacattgaaagacaactcttaagaaataggagctcatagtttctctgtgtgatggaatataagttaaatcctgtttttatctttctgtcttaagtttttaattttatttgggggaaataagactgttaggaattaagtgttagcatcactaacaatctagggttaaagctatagctagaaacagcccagtttttaactggaaactagtggtagaaaagttctttgctattacttgccagtttccaaaaactgtcttgatacatgcataaaaacagcatattttagaaactcttataaccggtgattatcatttatctgtaggttatccttgagaactcagcctgaaagatagataaccagagagattggttataaggaaattatatagaaaataagtggtaattttctgctcagtaattcaatcatacagctatcttttgaatgcccatttacaagtagattttctgctagacacagttacatt

SEQ ID NO: 429920 - DNA, 4152 bp, Homo sapiens
  misc_feature (2970)..(2970): n is a, c, g, or t
tgtcgtcctcttgatgggtcagtcactctgatgtcctgcttctgaatcagcctgttttacttcaatagcaaagaaaaggaaaaccatctgtattagtctgttctcacgcggctaataaagacacacctgagactgggtaatttataaaggaaagaggtttaatggactcatagttctgcatggctggggaggcctcacaatcatggaagaaggtgaaggaggagcaaagggaagtctatcatggcagcaggcgagacagtgtgtgtaagggaactcccatgtacaaaaccatcaaatctcttgagacttatttactatcatgagtacagcatgggaaaacctgtccccatcattcagttacctcccaccaggtcccttccaggatatctggggattatgggagctacaattcaagatgagatttgggtggggacacagccaaaccacgtcaccatctggtttgacttctccttagaggccacatcatgggcctgtcagccaccataattctgggactcttttcccaagttcatgtccataacccctcttccgtctgcaactgggaggtcagctttcatgaacattcccaggagaaagcgaggtggggaggaggtggagctggaaaactgccaaccctaaagagaaaggagtacctttgggcagttacctagggtagaagagctgttcgcacaaagaacccacagtactaaaatgactttcacagactccactcataggcaaggctgctattgagctgatgaacactggcacagccatgccagttgctaaaatacagaaattcttttgtgtaaattgataaagagcaaccaccctggacactctaagtctagtccaactgcccaaagtcaccctgacccaaagtcaaccatttaagatgatcccatgagccagcaagtaaagggttaatgtttggcggggctggggcaccaggactctctttcacaccccctcccaaggcgtgatgcccagtgcttggtcatggtctgtcagtattccaaatatcattcctgcgctgggagatcagaaatatttgcagatatgactgtctggtccacttggtgctgcacttctaagacccattttagagttgagtcaagggaaaaggaaaagtggctgcaggccgggcgcagtggctcatgcctgtaatcccagcactttgggaggccgaggcgggtggatcatttgagatcaggagtttgagaccagcctgaccaacatggtgaaaccccatctctactaaaataaaaaaattggccgggtgtggtggcgggcacctgtaatctcagctactcaagaggctgaggcagtagaatcacttgaacccaggaggcagagattgcaatgagccaagattgtgccactctattgcagcctgggtgacagtgagactgcctctcaaagaaaaaaaagtgggtgcaaatatctggggtgtttcagagggccaaatgtcaaggaacaaacctactacttggatctgtcactttaagtgaatgtttgttttctggtttgtagggaagaaggtattttatccagttcttttcagtcagtacaatcctggcataatatacggccaccatgatgcagtccctcccttggaacagcagctggtgagtaattaccctgcagatggctctgtgtggctctgtttagtgtctgtcattaccaggggtacctgaccatgagcaaaggtgagtagaaatctgtgcaatgattcccttagtagtttttacgtttggcagatgtgctggcctctgctcccggcgcctcgttgattaaaagtgcttgcaatatttaaagtggaaaataaatggaagcagtactttacagagaggtaatttcacaccttcatagtttccatcactggtttttggaaactggtattgttgcattatggatgcagtacagtttctcttgatttttgcaaaatcctacaaggtaacaaaggtgagatttatgttcccatttgacagaaatcagaatggggtggctcaccccagagagggccagagcaattccctggaccttgcaggcaaataaggtctttgtgaatttgaagtggaaactcccagtgtgctcccagtgcccttcccgtcatgccaccgttcccttcccatcatgccactgttcccacacatcacagtgtttgggtagacgttagcattaaaggtgtcactggcaaggtggctctcaaaggaatattggaaggacttctctgctaagatcctggctgcacaggtgatggatagtggatgcacacagcccccaagggtccctgtagggtgagatgtctctgttgtcacaggcagttagtccactttgcagagaagcaatgcaagcagcaggaggaaaggcaagccagaagaggatctctgtgtcttctgggcatggcccccatggatggaatttcccggtattgttgacagcattggcagagagggaaaaggcccttctcccacctcaagttgggctgtgattttttcctgcggggagatgagccaggtttgtctgaagctgtgttctggcccaggctgtatctcatggtggccttcccatctgagggacgtctgttcttctttgctgtgggtagctctgcctcttgctaaagaaaatccatgcttcttcccactgaggaccccttagggtggaggaaggacatctgctgtgggaacctgaagacacgatagcaccaggcctctgatgcttccgtacaatgggagagtaaactgatttccatccaaaacccatgttctggatgcgtttgaggattgactttgtgtgtaagcttctagaaatagcaaacctgttgtttccagccccatcctgtgcctttcatcctctctccccaagttaacctctggcaactgatattatgatattttccagaaagtttcaactttggggccctcaggttggacaatgtcatgtcttatatcctagcatggcttcatnttggggtgcaccaggtttactaataatacagttctcttttcccctagtggaattgcaataccacagatatactgtgtatctgtttttgtagtgtatctgtatctgtgctttatacataaaaacagtaagagtttttcacgtcttaagaatcagttttcagctgggtttggtggctcatgtctttaatgccagcactttgggaggccgagatgggcagatcacttgaggccaggagtttgagaccagcctagccaatgtgtcaaaacccatctctactaaaaaataaaaaattaggcgtgcatagtggcacacacctacagtcccagctactaggcaggttgaaaatcgcttgagcctgggaggcagaggctgtagtgagctgagatcgcaccactgcactccatcctgggtgatggagtgagaccctgtctcaaagaaaaaaaaaaagtgagttttcatctatagtcatgtgttacttaacaatagagagatgtcatgtatcgtcaggcaatttcatcattgtgcaaacatcatacagcgcacttatgcaatcctacataacatagccaactacacacgtaggctgtatggtacaggctgttgctcctaggttacaaacctgtacagcatgtgactgtcctgaatactacaggcaattgaagcacgatggtattcagtatctaaacatagaaatggcacaggaaaaatatggtataaaagattttaaaaatggttcccatgagtggagcttgtaatacaggactagaatttgctctgggtgagtaaatgagtggatggtgagtgaatgtgaaggcctgtgacattactgtccactactgtggactttataaccactgtagacttaggtgacactaaacttattttttaaaagttttccttggccgggtgtggtggcccacacctgtaatcccagcactttgggaggccgaagcaggtgaatcatgaggtcaggagttcgagaccagcctggctaacatgatgaaaccccatctctactaaaaattcaaaaattagctgggcatggtggtatgcgcctgtaatcccaactactccacaggctgaggcaggagaatcacttaaacccgggaggcagaggttgcagtgagccgagatcgtgccactgcactccagcctgggcaacagagcaagactctgtctcag

SEQ ID NO: 429921 - DNA, 489 bp, Homo sapiens
attgtgtgtgtgtgtgtgtgtgtgtgtgtgttttcatatctatgccctagaaacattccagccagaggtgccaaaaatcacaagaccttgttttgggactggtgtgtgtactgtattcctgactgtctgcaaggactcaaatccatctgcgtttcctgcaccagtggaggctgtttatcagtgatgggatgggctccacactccacggtggctcacaggagtttgtgaacactctatttttgtccaccctaaactttcccctcaaatgacagtgcttttcttgcaggtcataaagaaggaaactggattttggagagactttggatttgggatgacgtgtcagtatcggtcagacttcatcaatataggtaggacaaatctgcatctctactgccacccagaggccacgggcccatgtaggccttgaaggaatcaagtagggtttccaaggagtctggttgggaaggtggtaccattgccttcaaaaaa

SEQ ID NO: 429922 - DNA, 2956 bp, Homo sapiens
aatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacatgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttgattgtgcggtgttggatcttagaagctgtgatggctcagatgcacatattggctgaggataaccagctaagtgatttcaccagcttgttttaaacatagaaaatcctactgtctaattataaatcttgaaagatcaagctgattttttatttctttttttttgagatggagtcttactctgtcacccaggctggagtgcagtggcacgaactctgctcactgcaaccttcacctcccaggttcagggagatgtgcattgagcaggatgggagagtccatctcactgttgtttactttgggaaagaagaaataaatgaagtcaaaggagtacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatga

SEQ ID NO: 429923 - DNA, 3101 bp, Homo sapiens
aatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacatgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttgattgtgcggtgttggatcttagaagctgtgatggctcagatgcacatattggctgaggataaccagctaagtgatttcaccagcttgttttaaacatagaaaatcctactgtctaattataaatcttgaaagatcaagctgattttttatttctttttttttgagatggagtcttactctgtcacccaggctggagtgcagtggcacgaactctgctcactgcaaccttcacctcccaggttcagggagatgtgcattgagcaggatgggagagtccatctcactgttgtttactttgggaaagaagaaataaatgaagtcaaaggagtacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatgaaaaacaacacactctacccacacaacaaaaaacacctttttgcggcccgccctcggccccgaaaaacttttccaaaccccctcctttgggcggcgggccccaagtttagttgaaacttggccccacgccgttccccacgaggaac

SEQ ID NO: 429924 - DNA, 2669 bp, Homo sapiens
aatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacatgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggagtacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatga

SEQ ID NO: 429925 - DNA, 3623 bp, Homo sapiens
tgtcgtcctcttgatgggtcagtcactctgatgtcctgcttctgaatcagcctgttttacttcaatagcaaagaaaaggaaaaccatctgtattagtctgttctcacgcggctaataaagacacacctgagactgggtaatttataaaggaaagaggtttaatggactcatagttctgcatggctggggaggcctcacaatcatggaagaaggtgaaggaggagcaaagggaagtctatcatggcagcaggcgagacagtgtgtgtaagggaactcccatgtacaaaaccatcaaatctcttgagacttatttactatcatgagtacagcatgggaaaacctgtccccatcattcagttacctcccaccaggtcccttccaggatatctggggattatgggagctacaattcaagatgagatttgggtggggacacagccaaaccacgtcaccatctggtttgacttctccttagaggccacatcatgggcctgtcagccaccataattctgggactcttttcccaagttcatgtccataacccctcttccgtctgcaactgggaggtcagctttcatgaacattcccaggagaaagcgaggtggggaggaggtggagctggaaaactgccaaccctaaagagaaaggagtacctttgggcagttacctagggtagaagagctgttcgcacaaagaacccacagtactaaaatgactttcacagactccactcataggcaaggctgctattgagctgatgaacactggcacagccatgccagttgctaaaatacagaaattcttttgtgtaaattgataaagagcaaccaccctggacactctaagtctagtccaactgcccaaagtcaccctgacccaaagtcaaccatttaagatgatcccatgagccagcaagtaaagggttaatgtttggcggggctggggcaccaggactctctttcacaccccctcccaaggcgtgatgcccagtgcttggtcatggtctgtcagtattccaaatatcattcctgcgctgggagatcagaaatatttgcagatatgactgtctggtccacttggtgctgcacttctaagacccattttagagttgagtcaagggaaaaggaaaagtggctgcaggccgggcgcagtggctcatgcctgtaatcccagcactttgggaggccgaggcgggtggatcatttgagatcaggagtttgagaccagcctgaccaacatggtgaaaccccatctctactaaaataaaaaaattggccgggtgtggtggcgggcacctgtaatctcagctactcaagaggctgaggcagtagaatcacttgaacccaggaggcagagattgcaatgagccaagattgtgccactctattgcagcctgggtgacagtgagactgcctctcaaagaaaaaaaagtgggtgcaaatatctggggtgtttcagagggccaaatgtcaaggaacaaacctactacttggatctgtcactttaagtgaatgtttgttttctggtttgtagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatga

SEQ ID NO: 429926 - DNA, 2471 bp, Homo sapiens
ttttacgaaacctctatttttaattattatgcgcatgtttatggggtacatgtgatgttttgatacaggcatacaatgtgtaatcatcacatcagggtcatgggaggtatccatcatttcaattatttatcatatttatcagtcttctagctatttttaaatatacaataaattgttaacaatagctaattcataatcacaataagtctgtcagtaataatgctaccgaatactagatcttatttttgtacccattaaccacgaggctggggctgttcattagcattgctgataactcttgaatgcaggcaaatgcttggaattttcttggaggtcctgtcatctgaagaagtcggtgctgtctgccataaaagtcgtctttgttggggaattctcggggcttctgacccaggtggacactctcgtaccttggaggggtggtggtgaagcacgcatcccccccagtcatgtcttaatgaaaagtttgtgcttgttgcaactcagggaagcaaaacagatcagtgcagtgtgattcaacagtgtgttctgtcccgacaggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatga

SEQ ID NO: 429927 - DNA, 1737 bp, Homo sapiens
aatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacatgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttgattgtgcggtgttggatcttagaagctgtgatggctcagatgcacatattggctgaggataaccagctaagtgatttcaccagcttgttttaaacatagaaaatcctactgtctaattataaatcttgaaagatcaagctgattttttatttctttttttttgagatggagtcttactctgtcacccaggctggagtgcagtggcacgaactctgctcactgcaaccttcacctcccaggttcagggagatgtgcattgagcaggatgggagagtccatctcactgttgtttactttgggaaagaagaaataaatgaagtcaaaggagtacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgccttgagtcgttctgccattctttatccgtacgcgccgcacctttatactcatatgactcagcccattagccaggctctagtttctacgatgctcacatactatacagcacgacaggcctgggtctcccg

SEQ ID NO: 429928 - DNA, 254 bp, Homo sapiens
ctgcagcggggctgaacagagcgctcgaggggcggcgcagcagctgcgctagcttcagttgacgcgtccagactagtgcgtgccagcagagcacgcgcggtccaccggcagagcgccgctgcacaggagcgtgaaggacttagccgactgcgctgctttttcaaaacggatccgggcaatgcttcgttttctaaaggatgctgctgttgaagctttgaattttacaataaactttttgaaacaaaaaaaaaatc

SEQ ID NO: 429929 - DNA, 1203 bp, Homo sapiens
cacagttgcccccaaactgcctgtgctcctcgatggtgtctctccctccagaaaacgcatgcttattgaccttggttttgatctgcttggccgtgtcggtgaggaagatggaggagttggggtcgctggcactcgctggtggtgggcgcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggatgcagggtgccgggaaagcgctgcatgagttgctgctgtcggcgcagcgtcagggctgcctcactgccggcgtctacgagtcagccaaagtcttgaacgtggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcgaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagctttgaattttacaataaactttttgaaacaaaaaaaaaatc

SEQ ID NO: 429930 - DNA, 1460 bp, Homo sapiens
cacagttgcccccaaactgcctgtgctcctcgatggtgtctctccctccagaaaacgcatgcttattgaccttggttttgatctgcttggccgtgtcggtgaggaagatggaggagttggggtcgctggcactcgctggtggtgggcgcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggtgggtttcagggcgctgagaaagccgctggtcggtcggcgaccgtcagggttttccagggtgggaatccgcggggtaggaggggagcgcgggggtccgggcgccagatcccggttggagagccggggtgcaggcgctgagccgggattggagtgtggttggagttggggagccaagggtgtgtgccggtggccggggctggggtctccgccgcgccctccggccggctcccgctcactgcgctggctcctccgcaggatgcagggtgccgggaaagcgctgcatgagttgctgctgtcggcgcagcgtcagggctgcctcactgccggcgtctacgagtcagccaaagtcttgaacgtggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcgaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagctttgaattttacaataaactttttgaaacaaaaaaaaaatc

SEQ ID NO: 429931 - DNA, 3153 bp, Homo sapiens
ccggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccggaagccatggcacactaccccacaaggctgaagaccagaaaaacttattcatgggttggcaggcccttgttggatcgaaaactgcactaccaaacctatagagaaatgtgtgtgaaaacagaaggttgttccaccgagattcacatccagattggacagtttgtgttgattgaaggggatgatgatgaaaacccgtatgttgctaaattgcttgagttgttcgaagatgactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcaacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagagggatgcaaaagaagcaaaagcccagaatgaagcgacctctactccccatcgtatccgcagaaagagttctgtcttgactatgaatcggattaggcagcagcttcggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtctcaagcctagaacgccacgttgtgccgctcctcagatccgtagtcgaagcctggctgcccaggagccagccagtgtgctggaggaagcccgactgaggctgcatgtttctgctgtacctgagtctcttccctgtcgggaacaggaattccaagacatctacaattttgtggaaagcaaactccttgaccataccggagggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcagaagctaacaggccaaaaagcaacagccaaccatgcggcagaactgctggcaaagcaattctgcacccgagggtcacctcaggaaaccaccgtcctgcttgtggatgagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactgggtcttaccaggatgtgcttccagccctatacatatagccagctgcagcagatcctaaggtcccggctcaagcatctaaaggcctttgaagatgatgccatccagctggtagccaggaaggtagcagcactgtctggagatgcacgacggtgcctggacatctgcaggcgtgccacagagatctgtgagttctcccagcagaagcctgactcccctggcctggtcaccatagcccactcaatggaagctgtggatgagatgttttcatcatcatacatcacggccatcaaaaattcctctgttctggaacagagcttcctgagagccatcctcgcagagttccgtcgatcaggactggaggaagccacgtttcaacagatatatagtcaacatgtggcactgtgcagaatggagggactgccgtaccccaccatgtcagagaccatggccgtgtgttctcacctgggctcctgtcgcctcctgcttgtggagcccagcaggaacgatctgctccttcgggtgcggctcaacgtcagccaggatgatgtgctgtatgcgctgaaagacgagtaaaggggcttcacaagttaaaagactggggtcttgctgggttttgttttttgagacagggtcttgctctgtcgcccaggctggagtgcagtggcacgatcatggctcactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctgattttggaagtacatggaattgttgtaacaaagtatattgaatggaaatggctctcatgtattttggaattttccattaaataatttgcttttt

SEQ ID NO: 429932 - DNA, 3173 bp, Homo sapiens
ccggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccggaagccatggcacactaccccacaaggctgaagaccagaaaaacttattcatgggttggcaggcccttgttggatcgaaaactgcactaccaaacctatagagaaatgtgtgtgaaaacagaaggttgttccaccgagattcacatccagattggacagtttgtgttgattgaaggggatgatgatgaaaacccgtatgttgctaaattgcttgagttgttcgaagatgactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcaacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagagggatgcaaaagaagcaaaagcccagaatgaagcgacctctactccccatcgtatccgcagaaagagttctgtcttgactatgaatcggattaggcagcagcttcggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtctcaagcctagaacgccacgttgtgccgctcctcagatccgtagtcgaagcctggctgcccaggagccagccagtgtgctggaggaagcccgactgaggctgcatgtttctgctgtacctgagtctcttccctgtcgggaacaggaattccaagacatctacaattttgtggaaagcaaactccttgaccataccggagggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcagaagctaacaggccaaaaagcaacagccaaccatgcggcagaactgctggcaaagcaattctgcacccgagggtcacctcaggaaaccaccgtcctgcttgtggatgagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactgggtcttaccaggatgtgcttccagccctatacatatagccagctgcagcagatcctaaggtcccggctcaagcatctaaaggcctttgaagatgatgccatccagctggtagccaggaaggtagcagcactgtctggagatgcacgacggtgcctggacatctgcaggcgtgccacagagatctgtgagttctcccagcagaagcctgactcccctggcctggtcaccatagcccactcaatggaagctgtggatgagatgttttcatcatcatacatcacggccatcaaaaattcctctgttctggaacagagcttcctgagagccatcctcgcagagttccgtcgatcaggactggaggaagccacgtttcaacagatatatagtcaacatgtggcactgtgcagaatggagggactgccgtaccccaccatgtcagagaccatggccgtgtgttctcacctgggctcctgtcgcctcctgcttgtggagcccagcaggaacgatctgctccttcgggtgcggctcaacgtcagccaggatgatgtgctgtatgcgctgaaagacgagtaaaggggcttcacaagttaaaagactggggtcttgctgggttttgttttttgagacagggtcttgctctgtcgcccaggctggagtgcagtggcacgatcatggctcactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctgattttggaagtacatggaattgttgtaacaaagtatattgaatggaaatggctctcatgtattttggaattttccattaaataatttgctttttaacacacaaaaaaaaacaca

SEQ ID NO: 429933 - DNA, 1674 bp, Homo sapiens
ccggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccggaagccatggcacactaccccacaaggctgaagaccagaaaaacttattcatgggttggcaggcccttgttggatcgaaaactgcactaccaaacctatagagaaatgtgtgtgaaaacagaaggttgttccaccgagattcacatccagattggacagtttgtgttgattgaaggggatgatgatgaaaacccgtatgttgctaaattgcttgagttgttcgaagatgactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcaacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagaggtgaccagggacattacccacagagcaaattgaaatccttcacatcacgtgaagtatgtgagtcatagtcaaaaaagttagaacagtagttgaaaaacctatgtcacagaagtattggggagctttcttaaaatacagatttctaggcctcttcccacacctagtgagtcagactccaagcactggccctaggaatctgtatttggaaatgctcttcagatggttccagtataccgagctgttatttggggatcattgctatagaagataacttcccaaacctgcattgctatccagtttgggatttcattagttcctgtggctttttgccacactttaacagtcattttttaaagcagtttttcattgtta

SEQ ID NO: 429934 - DNA, 578 bp, Homo sapiens
aaatatgttctttgttttcaatacagctcaagcctagaacgccacgttgtgccgctcctcagatccgtagtcgaagcctggctgcccaggagccagccagtgtgctggaggaagcccgactgaggtactgctgctgttgattccccttcagagaggcaggaaccatggggcctctgctttcattcacataaaattagcagtcactggtctacctaataaaggtagatacactgtgtgtctatacttttacctatctaggtaaagtgagtgtatgtttagaaaaaagaaacctctcaggcagcatctgggttagccagtgtggacaggccctgggaggactggccttcccgtctactgccatcatttccgcagggatggaagatgattagtcaggacagtgcctctttgttttgatgccctttagaaccatatggagactttcatataagtctggatcctgtcagaaatcaagcaaaatctgaatctcctgtgggatgaggtccacccatgtgatttgggtggagaaacggaggccaaggattatgaggccaaatggagggatttgagaatgaagggat

SEQ ID NO: 429935 - DNA, 2624 bp, Homo sapiens
ccggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccggaagccatggcacactaccccacaaggctgaagaccagaaaaacttattcatgggttggcaggcccttgttggatcgaaaactgcactaccaaacctatagagaaatgtgtgtgaaaacagaaggttgttccaccgagattcacatccagattggacagtttgtgttgattgaaggggatgatgatgaaaacccgtatgttgctaaattgcttgagttgttcgaagatgactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcaacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagagggatgcaaaagaagcaaaagcccagaatgaagcgacctctactccccatcgtatccgcagaaagagttctgtcttgactatgaatcggattaggcagcagcttcggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtctcaagcctagaacgccacgttgtgccgctcctcagatccgtagtcgaagcctggctgcccaggagccagccagtgtgctggaggaagcccgactgaggctgcatgtttctgctgtacctgagtctcttccctgtcgggaacaggaattccaagacatctacaattttgtggaaagcaaactccttgaccataccggagggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcagaagctaacaggccaaaaagcaacagccaaccatgcggcagaactgctggcaaagcaattctgcacccgagggtcacctcaggaaaccaccgtcctgcttgtggatgagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactgggtcttaccaggatgtgcttccagccctatacatatagccagctgcagcagatcctaaggtcccggctcaagcatctaaaggcctttgaagatgatgccatccagctggtagccaggaaggctggagtgcagtggcacgatcatggctcactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctgattttggaagtacatggaattgttgtaacaaagtatattgaatggaaatggctctcatgtattttggaattttccattaaataatttgcttttt

SEQ ID NO: 429936 - DNA, 1751 bp, Homo sapiens
gccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaaaaaaaaaaaaaaaaaaaaaaaaaaaaaaaaaaaaaaaaaaaaaaaaaaaaaaaaaaaaaaaaaaaaaagggggggcggcgccggcctaacaacacccagccggggggacaccagtcgtacaccacggccccacgagtctgctgtgaagcaagagggagggcacacatgagggggcagctactaatatattaaacacacagaggcgaggagcacctattataacaaaacacacgcgcagatcggggagaaaaaagccgcgcatcacccgagcggcaataaattcatgggaggagaagcagagcacccccacacacacacggcgcgggcgggcgcaccaaaaccaccgacgtgcggggcacacacacacccctcgaaacgataatcaataaccacccacgccacagcgacaacaaaataacaaacaaataagagacgagcacattgggagcgtgaccaaaacacacaccaccagcaagacaccccgcgacgaggaaggagaaaaaaaacacgctaggcggacccaaggaggcgagcacaacacctcaccaagggacaaaacatcccatacaacaccgggggcgctgctgcacacacaacaccccaaccaaagaaaccagaaaacagaaagcaccaacaaaaacacaaaacaaaccagccgaccacaaaagcaacaccacacacacccacgaaacgcaacacagcaaccgaaagagaagagaagcagagtacaaaagggcaagagacaaaaataaaaaagaaaaagagaaaaacaaacagaagagaacaacacgagcaacaacacagacacaacaaaacacaaaacagacagacaaaagacagacaagagacaaggcaaaagacacagccagaaacacaaagaaaaacaagaaacacgagaagaggacaaaagacagaaacacgcaacaaaagagtcccaaaacaagaacaacgcaataaccactacacgaaaaaaaaacacagagagacgaaaggtaggacaaacaacaaaaaacagaaaaagaacacaaagctacaaagaccacaaaag

SEQ ID NO: 429937 - DNA, 867 bp, Homo sapiens
gccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaaagttgtttgtgttattgcacaatttgaaaattatgtcgggacataccctatagaattactaaccttactgccccttgtagaatatgtattaatcattctacattaaagaaaataatggttcttactggaatgtctaggcactgtacagttattatatgtcttgg

SEQ ID NO: 429938 - DNA, 493 bp, Homo sapiens
gcgcgcgggaaatcccgagtgcatctggaatacgcagagtcagtaagaccatggctacgtcctcgatgtctaagggttgctttgtttttaagccaaactccaaaaagagaaagatctctctgccaatagcatttatgttccaaggcattggtcaaagagataagaggacaccccagggctctaattgaaaagagaatccaattacaccttccaaagtaattctacctgctagagcacaaagttatggaatcacctggactataagtaaaggaattggagtgtgatcctgagcctgaccagctctatggctttggccctgctgtttaacctttccctaagtctcttcatctgtaaaatgagcaactatactcacttatcactaagatttctccctattctcattctatctctctaagagctaacatgtagtgctttgtaagactatcataaataccatgtgaataaatttgtgttattatggattgttaaaaac

SEQ ID NO: 429939 - DNA, 2694 bp, Homo sapiens
gcgcgcgggaaatcccgagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtataaattatttgcagttgctttagcaatcctcattcctcctctcccaattccctgcattggcattcctcactttagtgtagtaggcagtaagtaacatgaatatcttacaggttgtttctcctggtgactacataggttccaaaactgtctctgcctctccatttcctgtagtcttacaacttta

SEQ ID NO: 429940 - DNA, 2144 bp, Homo sapiens
gcgcgcgggaaatcccgagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattagtatccttttaaaaccatttctacaatgtccaactacacataaaatataagtttataatttctccagg

SEQ ID NO: 429941 - DNA, 1911 bp, Homo sapiens
actctttctttctgcaatggcttaaaagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtata

SEQ ID NO: 429942 - DNA, 1892 bp, Homo sapiens
tattggggttggttaagttattatttctaatcagccttatctcaagtcttgtcattttacattaaacaagagaatacttgagaaagtgtaagatctttctgctctgggagcaaaacataatctttggctaagaataagaggactagactgggtgcagtggctcacgcctataatcccagcactttgggaagccgaggtgggcggatcacctgaggtcaggagttcgagactagcctgaccaatatggtgaaaccctgcctctactaaaaatacaaaattagccgggcatggtggtgcatgcctgtaatcacagctactcgggaggttgaggcaggagaatcgcttggacctgggaggcagaggttgcggtgagccgagatcacgccattgcaccctagcctgagcaacaagagcaaaactgcgtctcaaagaaaaaacaaaaaaagaataagaggactaataactatttgaatccctggcagtttacatctgagtaccttctccaagtgacacattaagagttatgactaatgaagtttgcttccaaagttatatgaaataatgccctcttttttggtctcctggataataggctaggtttggccttccttgatattcagttatttggagctcaaagtggacaagagctgttgctgcccctatcctgggaagctaatccttcacatgctgctaacttgggttagatcttctgccagcaaaacctcacccgtctttcccctccaagcaagtcagtgccggtgattccttggacaccagaaatgctaatcttgtctatttgaataggcctaaaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtata

SEQ ID NO: 429943 - DNA, 1071 bp, Homo sapiens
gcgcgcgggaaatcccgagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcaggtagatggtgtattacctggcttttatgaaaaactccctttttaagaaaatactacttttaacttgaaaagtataatcttcattttaataccaactggataaaaatcaaagtattcaaattctttataattgaatattcaaagacttcctatcagattttccatttgctttttgagccaagaatgagaatcaaaggcacatttagccagttttaaattgacatggtaagatagtattaaatatggtttttctcaccaagattgactgtctcttactcacccattaaatagataaactactccaggttg

SEQ ID NO: 429944 - DNA, 893 bp, Homo sapiens
aggttgggggcttcattaatgtctgattttattcctaataatttataaaagttagtcatcttagtttactgttaattgttagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtataaattatttgcagttgctttagcaatcctcattcctcctctcccaattccctgcattggcattcctcactttagtgtagtaggcagtaagtaacatgaatatcttacaggttgtttctcctggtgactacataggttccaaaactgtctctgcctctccatttcctgtagtcttacaacttta

SEQ ID NO: 429945 - DNA, 557 bp, Homo sapiens
gcgcgcgggaaatcccgagtgcatctggaatacgcagagtcagtaagaccatggctacgtcctcgatgtctaagggttgctttgtttttaagccaaactccaaaaagagaaagatctctctgccaatagcatttatgttccaaggcattggtcaaagagataagaggacaccccagggctctaattgaaaagagaatccaattacaccttccaaagggataaatgctgtgcacatcaatacatgctgagaaaaaagcccaaggtcttggatctcttacagtaattctacctgctagagcacaaagttatggaatcacctggactataagtaaaggaattggagtgtgatcctgagcctgaccagctctatggctttggccctgctgtttaacctttccctaagtctcttcatctgtaaaatgagcaactatactcacttatcactaagatttctccctattctcattctatctctctaagagctaacatgtagtgctttgtaagactatcataaataccatgtgaataaatttgtgttattatggattgttaaaaac

SEQ ID NO: 429946 - DNA, 415 bp, Homo sapiens
aattcaagagacttgggcggtcaaataaaactcagagaaattccaactgctgctcttgttcttggtatatatgcgtatgtttgttcatgcatgcatctctgtgtatttcgtttttaaatttttttttattgttgagaatagtggaaggacctgttttgatgagcctattttgtctctcttatttgtacaattaaaccaactatagtttatattacatattttcaaaaaccaataaaaattccttatctttacagacgatcatatgtttgtaaattaaaaggaatttatctagctaatgttctccccaacttttggtcggaagggaaaatatatttgttttactctttctttgtagatacattacaagagtatatgagatttggtaataaagaaactaccagtgttagtagatttg

SEQ ID NO: 429947 - DNA, 2512 bp, Homo sapiens
gcgcgcgggaaatcccgagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtata

SEQ ID NO: 429948 - DNA, 2599 bp, Homo sapiens
gcgcgcgggaaatcccgagtgcatctggaatacgcagagtcagtaagaccatggctacgtcctcgatgtctaagggttgctttgtttttaagccaaactccaaaaagagaaagatctctctgccaatagcatttatgttccaaggcattggtcaaagagataagaggacaccccagggctctaattgaaaagagaatccaattacaccttccaaagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtata

SEQ ID NO: 429949 - DNA, 1781 bp, Homo sapiens
atggaaagctttgccacaaaagtactacaagataacgacaacaggaggagactgccattggctagaagtagtcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtata

SEQ ID NO: 429950 - DNA, 1091 bp, Homo sapiens
gcgcgcgggaaatcccgagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccttttataaagttttgaactgagaaatcatgacccacgcgttcgcccacgcgtccgggcagacgccttcaccgagactggcgctgtctacccgctacagccctgatgagatgaacaacagtcccaacttcgaagaaaagaagaagt

SEQ ID NO: 429951 - DNA, 5947 bp, Homo sapiens
cagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacggcagaatgcaggaccccgtaggcaaaatcacaaccttgctattaaaaaaaatttttttttacatacacatttgcaggtgttccctagagtgtggtgttttgaatttgctctttgtcatctgtataattgccaaatgattatagtgatacacatgacctgcattcacttttttctagtttccttaattatgtttagaataaattcgtttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacacta

SEQ ID NO: 429952 - DNA, 1003 bp, Homo sapiens
tggcatggtgctcttaggttataataatgtaacttcaatttttgaaaggcaaaatattttaccaagaccatgatttaatccaggcagtggaaaagatgagcttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacacgtaagccttttgcctcttggggatgcaggtttgaaggggtggaaaatgtttttgcctgattgcatgtttgaacgaaagactattttattttaaattctttaggttttgggggtttttttccccccaagagcatcctccttagtaaaaatgacagctgctcatagctctaagcaagtggcttatgacacaggatttataagagactcttctcaaaagtaaattatgtagaaatatgagaatacatttaagcaaatatgaatccttatctatttatgatcctgcttgggtggctttcaagtttgattttggaagttttgccttatcatatagtttgtagaacatgaattttgaaaaaacatttcaacatatttttatgtttagtacagaggtggatctagttgccaaatgaatgtgtcctaagtcactagaaatagatgaaaacacaaaaagagattatagatgctctcaccaagtgggagggtcagaagggagttttcccagtatcttatgaaggcttgtgttccaacaagagttatattgtttgaatatagttaaagctggaggaactgagagtgctgccgtcatgctgggaagacaatgggaccactttcttgtgccacacattgttatctggtgacttggttgttgttggttatgagacttcactctcagggctgcactatccagtggtg

SEQ ID NO: 429953 - DNA, 1003 bp, Homo sapiens
tggcatggtgctcttaggttataataatgtaacttcaatttttgaaaggcaaaatattttaccaagaccatgatttaatccaggcagtggaaaagatgagcttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacacgtaagccttttgcctcttggggatgcaggtttgaaggggtggaaaatgtttttgcctgattgcatgtttgaacgaaagactattttattttaaattctttaggttttgggggtttttttccccccaagagcatcctccttagtaaaaatgacagctgctcatagctctaagcaagtggcttatgacacaggatttataagagactcttctcaaaagtaaattatgtagaaatatgagaatacatttaagcaaatatgaatccttatctatttatgatcctgcttgggtggctttcaagtttgattttggaagttttgccttatcatatagtttgtagaacatgaattttgaaaaaacatttcaacatatttttatgtttagtacagaggtggatctagttgccaaatgaatgtgtcctaagtcactagaaatagatgattttcccagtatcttatgaaggcttgtgttccaacaagagttatattgtttgaatatagttaaagctggaggaaagggacgttccgcttggtcctcctgaaagcagttattcagattgagccttagaactgagagtgctgccgtcatgctgggaagacaatgggaccactttcttgtgccacacattgttatctggtgacttggttgttgttggttatgagacttcactctcagggctgcactatccagtggtg

SEQ ID NO: 429954 - DNA, 956 bp, Homo sapiens
tggcatggtgctcttaggttataataatgtaacttcaatttttgaaaggcaaaatattttaccaagaccatgatttaatccaggcagtggaaaagatgagcttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacacgtaagccttttgcctcttggggatgcaggtttgaaggggtggaaaatgtttttgcctgattgcatgtttgaacccccaagagcatcctccttagtaaaaatgacagctgctcatagctctaagcaagtggcttatgacacaggatttataagagactcttctcaaaagtaaattatgtagaaatatgagaatacatttaagcaaatatgaatccttatctatttatgatcctgcttgggtggctttcaagtttgattttggaagttttgccttatcatatagtttgtagaacatgaattttgaaaaaacatttcaacatatttttatgtttagtacagaggtggatctagttgccaaatgaatgtgtcctaagtcactagaaatagatgaaaacacaaaaagagattatagatgctctcaccaagtgggagggtcagaagggagttttcccagtatcttatgaaggcttgtgttccaacaagagttatattgtttgaatatagttaaagctggaggaaagggacgttccgcttggtcctctgggaagacaatgggaccactttcttgtgccacacattgttatctggtgacttggttgttgttggttatgagacttcactctcagggctgcactatccagtggtg

SEQ ID NO: 429955 - DNA, 955 bp, Homo sapiens
tggcatggtgctcttaggttataataatgtaacttcaatttttgaaaggcaaaatattttaccaagaccatgatttaatccaggcagtggaaaagatgagcttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacacgtaagccttttgcctcttggggatgcaggtttgaaggggtggaaaatgtttttgcctgattgcatgtttgaacccccaagagcatcctccttagtaaaaatgacagctgctcatagctctaagcaagtggcttatgacacaggatttataagagactcttctcaaaagtaaattatgtagaaatatgagaatacatttaagcaaatatgaatccttatctatttatgatcctgcttgggtggctttcaagtttgattttggaagttttgccttatcatatagtttgtagaacatgaattttgaaaaaacatttcaacatatttttatgtttagtacagaggtggatctagttgccaaatgaatgtgtcctaagtcactagaaatagatgaaaacacaaaaagagattatagatgctctcaccaagtgggagggtcagaagggagttttcccagtatcttatgaaggcttgtgttccaacaagagttatattgtttgaatatagttaaagctggaggaactgagagtgctgccgtcatgctgggaagacaatgggaccactttcttgtgccacacattgttatctggtgacttggttgttgttggttatgagacttcactctcagggctgcactatccagtggtg

SEQ ID NO: 429956 - DNA, 5893 bp, Homo sapiens
cagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacggcagaatgcaggaccccgtaggcaaaatcacaaccttgctattaaaaaatttgctctttgtcatctgtataattgccaaatgattatagtgatacacatgacctgcattcacttttttctagtttccttaattatgtttagaataaattcgtttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacacta

SEQ ID NO: 429957 - DNA, 6130 bp, Homo sapiens
tggcatggtgctcttaggttataataatgtaacttcaatttttgaaaggcaaaatattttaccaagaccatgatttaatccaggcagtggaaaagatgagcttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacaccaagatgatgaagtgacgactgttcaggttaaagagcaagaccagagcgtcctggtgctgaagaaagtgcagtgctgtggcccagcccccacagctgggagtgcggagagccattggagatatgtggtggtgtccgggaccccggagaagattttggagcaccttttgaatgacttgcacctggaagaagtccaggacaaagaaacagttataccaacccctgggatcacatgtgtcacttctgccatgtgctcacaaagccaagcggaccaggacttcatggcttgactctcctagcaccaacctaagtggggaagaagggagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacggcagaatgcaggaccccgtaggcaaaatcacaaccttgctattaaaaaatttgctctttgtcatctgtataattgccaaatgattatagtgatacacatgacctgcattcacttttttctagtttccttaattatgtttagaataaattcgtttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacacta

SEQ ID NO: 429958 - DNA, 6016 bp, Homo sapiens
tggcatggtgctcttaggttataataatgtaacttcaatttttgaaaggcaaaatattttaccaagaccatgatttaatccaggcagtggaaaagatgagcttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacaccaagatgatgaagtgacgactgttcaggttaaagagcaagaccagagcgtcctggtgctgaagaaagtgcagtgctgtggcccagcccccacagctgggagtgcggagagccattggagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacggcagaatgcaggaccccgtaggcaaaatcacaaccttgctattaaaaaatttgctctttgtcatctgtataattgccaaatgattatagtgatacacatgacctgcattcacttttttctagtttccttaattatgtttagaataaattcgtttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacacta

SEQ ID NO: 429959 - DNA, 5678 bp, Homo sapiens
tttttcatatcttaattttaataaataatgtctttcctggctaaaattctcctaatccctcccacagctatcaatatttatcatatttctgccatgcacatggttctggggcccagataagcagctgctcttcttatccacctctttgcttaccttgtgtttgttttttttttctttgcagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacggcagaatgcaggaccccgtaggcaaaatcacaaccttgctattaaaaaatttgctctttgtcatctgtataattgccaaatgattatagtgatacacatgacctgcattcacttttttctagtttccttaattatgtttagaataaattcgtttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacacta

SEQ ID NO: 429960 - DNA, 1809 bp, Homo sapiens
  misc_feature (10)..(10): n is a, c, g, or t
  misc_feature (23)..(23): n is a, c, g, or t
tcggaatcgngctcggtcccacngggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacggcagaatgcaggaccccgtaggcaaaatcacaaccttgctattaaaaaatttgctctttgtcatctgtataattgccaaatgattatagtgatacacatgacctgcattcacttttttctagtttccttaattatgtttagaataaattcgtttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacacta

SEQ ID NO: 429961 - DNA, 1523 bp, Homo sapiens
tgcacggggatttgtgcaatataaactccaaatgagagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacggcagaatgcaggaccccgtaggcaaaatcacaaccttgctattaaaaaaaatttttttttacatacacatttgcaggtgttccctagagtgtggtgttttgaatttgctctttgtcatctgtataattgccaaatgattatagtgatacacatgacctgcattcacttttttctagtttccttaattatgtttagaataaattcgtttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacacta

SEQ ID NO: 429962 - DNA, 1393 bp, Homo sapiens
cagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttggtaaggaccttcagccttgtatttgaaacaaacaggccaggcgaggtggctcatacctgtaatctgagcactttgggaggccaaggcaggaagatggcttgagctcagaagtttgagaccagcttagaagtttgcaaccctgtctctacaaaaaaacttaagaattaactgggcatagtagtacacacctgttgtccctaggtgtgtgctgaggtgggaggatctcttcagcccaggaggtcaaggctgcaatgagttgtgatctcatcattgcactccagcccaggtgatagggtaggaccttgtctcaaaaaaaa

SEQ ID NO: 429963 - DNA, 1536 bp, Homo sapiens
cagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggaggtgagccttggagtcccatggtgaggggcacataaaatggaaataaagtaatttacatggattaaat

SEQ ID NO: 429964 - DNA, 1918 bp, Homo sapiens
cagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttgaggaagacaagatatggcagattattatcccctcatggcagcaagtttatgctgtgaagagtgactttacacactcagaaacctcctccccgcaactcccgctgactcctgtccccacagtgtcttgctttgcttgtccattggctcaaaatcactggtgagtttagcaggggtgaccttgcccctaacc

SEQ ID NO: 429965 - DNA, 235 bp, Homo sapiens
cagctatcaatatttatcatatttctgccatgcacatggttctggggcccagataagcagctgctcttcttatccacctctttgcttaccttgtgtttgttttttttttctttgcagagaccctcctggatgacttccttctcacgtacactgtcttcatgacaactgatgacttgtgccaggctctgttaaggcaatatccttcattatcttcaggctgctgtgtccacttcct

SEQ ID NO: 429966 - DNA, 674 bp, Homo sapiens
taaatgatggtataatgaactatcatataaccaattaaacatgacatatgtaaataattttggcaagtggataaagtgcttataagaatatgagaatataaaactatggaataattgcaaatgtatatgtgtatccgcaatagttataaatgcatatgcataaatcattgcaaatcaatgcaattatttgtgtgtgtatatatatacatggttatataaaaatcagaacaaaaatagacctaagtgtaaccagtgttaacatggtattgttatcttagatgagtaaattttactttttgtcttaaactgttctgtgttccaaacaatgactaaatgttataggaaataactgcaagaggactccactttctgaccgctgagcagtgagagctatttgtgatgccactggtatcattgtatagagtgtgcagaacttaattaatccactttaagttctatttacttttaagtatttttctttggcaagtttcactttttaagtgtactgtgtaggcctactgctgctactcttgtatttctgattattccttttttttttttttttttcaaataaagaaaagcatgaacttcagccaaatgacttagtcatctccaaatccctcgaggcatctggtcgaatatatgtctaccggaaagacctggcggacactttg

SEQ ID NO: 429967 - DNA, 2100 bp, Homo sapiens
cagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgagtaattgaagtcaggtgcggaatgtaaattgactctacgttggtaccaactgtggtcacaagtattgggtggtaatcaatttaaacagattgaaaagtatcatatgtatatacatacgcatattgtatatatatagtagattgtctctttgtttcctcactgcatgttggggatgcagaggaagacaagatatggcagattattatcccctcatggcagcaagtttatgctgtgaagagtgactttacacactcagaaacctcctccccgcaactcccgctgactcctgtccccacagtgtcttgctttgcttgtccattggctcaaaatcactggtgagtttagcaggggtgaccttgcccctaacc

SEQ ID NO: 429968 - DNA, 7769 bp, Homo sapiens
caagagtgcctgaggctggatcagaaatagccacgatcgtccagtttgattgattgattgattgatttagttgtgatggagtctcgctgtatttcccaggctggagtgcagaggcacgatctccgttcactgcagcctccacctccccggttcaagtgattctcctgcctcagccttccgagtagctgggattacaggcacctgccaccacgcccggctgatttttgtgtttttagtagagacagggtttcgccatgttggccaggctggtcttgaactcctgacctcaggtgagccacccgcctcggcctcccaaagtgttgggattacaggcgtgagccactgcccccagccccagcttgatcttgaacctcctgtgtgtgggcagagagacatggccctgctactgcttgaacggcttccggagacagtgacttgtttcctttttccctctgaactatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagaggggatgctggagaggaggaggagaagagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggtgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgaggggtgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccagctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcaccctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcgtgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaactttaaaaaaagaag

SEQ ID NO: 429969 - DNA, 436 bp, Homo sapiens
agttaggcatgaggaacagcacagaagacagacaacattacccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaactttaaaaaaagaag

SEQ ID NO: 429970 - DNA, 7328 bp, Homo sapiens
ccgagtctgacggcgccggttcgctgcccggtccgcccgcggtgagagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggtgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgaggggtgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccagctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcaccctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcgtgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaactttaaaaaaagaag

SEQ ID NO: 429971 - DNA, 7250 bp, Homo sapiens
ccgagtctgacggcgccggttcgctgcccggtccgcccgcggtgagagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctgggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggtgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgaggggtgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccagctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcaccctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcgtgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaactttaaaaaaagaag

SEQ ID NO: 429972 - DNA, 4979 bp, Homo sapiens
ccgagtctgacggcgccggttcgctgcccggtccgcccgcggtgagagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggtgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgaggggtgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccagctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcaccctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaactttaaaaaaagaag

SEQ ID NO: 429973 - DNA, 1948 bp, Homo sapiens
ccgagtctgacggcgccggttcgctgcccggtccgcccgcggtgagagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggtaaggccgagcccgcggcttcccgtcaccctcttactgacggggccagcagtcactccccgggatcacttctagctgcctttgtccccatcagaatggcagaattctcacactcaccagagtggcagaataaaaagatgaacactcacaggcgttggtgaggatgtggagaaactggagctctcctgtatggctaggagcaatgtaaatgagcagccgctgagaaacagtctggcagttcctttaaaggtgaaacacaagagttactctgtgacccagcagctccactcctaggagtcgcccaagagaaaaacatgtcctcacaaaaccttgtacacaaatgtctgtagcaacgtcgtttattatggccccgaggtggaaaccaccttcatggctgtccagtgatgaatgggtaaacaaaatgtggtccatccgttgcatggactattagccagccatgaaaagcaatggcatgctgctccacgctgtagcagggatagacctgggaaacatcgtgaaactcagtggaagaagccagacacagaagcccaagtattgtatcatccctatgaaatgtccagaactgcagattcctagagacacagcagatgacagattgcccgggcagagggtggggaatggggagcagggcgtgactgctgatggggatggggcttctttatggggtgagagaatgttctggaaatggtggtggctgcacaactctgtgaatacactaaaaatcactgaattgtatgttttagagggtgaatttcatggcaagtgaattatatcctaattaagctcttacatatatatacgtgaa

SEQ ID NO: 429974 - DNA, 813 bp, Homo sapiens
ccgagtctgacggcgccggttcgctgcccggtccgcccgcggtgagagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggtaagacatgggtgggctg

SEQ ID NO: 429975 - DNA, 6271 bp, Homo sapiens
  misc_feature (3955)..(3955): n is a, c, g, or t
  misc_feature (3964)..(3964): n is a, c, g, or t
  misc_feature (3974)..(3974): n is a, c, g, or t
  misc_feature (4026)..(4026): n is a, c, g, or t
  misc_feature (4029)..(4029): n is a, c, g, or t
  misc_feature (4039)..(4039): n is a, c, g, or t
  misc_feature (4060)..(4060): n is a, c, g, or t
  misc_feature (4066)..(4066): n is a, c, g, or t
  misc_feature (4081)..(4081): n is a, c, g, or t
  misc_feature (4093)..(4093): n is a, c, g, or t
  misc_feature (4142)..(4142): n is a, c, g, or t
  misc_feature (4161)..(4161): n is a, c, g, or t
  misc_feature (4588)..(4589): n is a, c, g, or t
  misc_feature (4634)..(4634): n is a, c, g, or t
  misc_feature (4661)..(4661): n is a, c, g, or t
  misc_feature (4673)..(4673): n is a, c, g, or t
  misc_feature (4686)..(4686): n is a, c, g, or t
  misc_feature (4695)..(4695): n is a, c, g, or t
  misc_feature (6048)..(6048): n is a, c, g, or t
  misc_feature (6146)..(6146): n is a, c, g, or t
  misc_feature (6268)..(6268): n is a, c, g, or t
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429976 - DNA, 6198 bp, Homo sapiens
  misc_feature (3882)..(3882): n is a, c, g, or t
  misc_feature (3891)..(3891): n is a, c, g, or t
  misc_feature (3901)..(3901): n is a, c, g, or t
  misc_feature (3953)..(3953): n is a, c, g, or t
  misc_feature (3956)..(3956): n is a, c, g, or t
  misc_feature (3966)..(3966): n is a, c, g, or t
  misc_feature (3987)..(3987): n is a, c, g, or t
  misc_feature (3993)..(3993): n is a, c, g, or t
  misc_feature (4008)..(4008): n is a, c, g, or t
  misc_feature (4020)..(4020): n is a, c, g, or t
  misc_feature (4069)..(4069): n is a, c, g, or t
  misc_feature (4088)..(4088): n is a, c, g, or t
  misc_feature (4515)..(4516): n is a, c, g, or t
  misc_feature (4561)..(4561): n is a, c, g, or t
  misc_feature (4588)..(4588): n is a, c, g, or t
  misc_feature (4600)..(4600): n is a, c, g, or t
  misc_feature (4613)..(4613): n is a, c, g, or t
  misc_feature (4622)..(4622): n is a, c, g, or t
  misc_feature (5975)..(5975): n is a, c, g, or t
  misc_feature (6073)..(6073): n is a, c, g, or t
  misc_feature (6195)..(6195): n is a, c, g, or t
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429977 - DNA, 6275 bp, Homo sapiens
  misc_feature (3959)..(3959): n is a, c, g, or t
  misc_feature (3968)..(3968): n is a, c, g, or t
  misc_feature (3978)..(3978): n is a, c, g, or t
  misc_feature (4030)..(4030): n is a, c, g, or t
  misc_feature (4033)..(4033): n is a, c, g, or t
  misc_feature (4043)..(4043): n is a, c, g, or t
  misc_feature (4064)..(4064): n is a, c, g, or t
  misc_feature (4070)..(4070): n is a, c, g, or t
  misc_feature (4085)..(4085): n is a, c, g, or t
  misc_feature (4097)..(4097): n is a, c, g, or t
  misc_feature (4146)..(4146): n is a, c, g, or t
  misc_feature (4165)..(4165): n is a, c, g, or t
  misc_feature (4592)..(4593): n is a, c, g, or t
  misc_feature (4638)..(4638): n is a, c, g, or t
  misc_feature (4665)..(4665): n is a, c, g, or t
  misc_feature (4677)..(4677): n is a, c, g, or t
  misc_feature (4690)..(4690): n is a, c, g, or t
  misc_feature (4699)..(4699): n is a, c, g, or t
  misc_feature (6052)..(6052): n is a, c, g, or t
  misc_feature (6150)..(6150): n is a, c, g, or t
  misc_feature (6272)..(6272): n is a, c, g, or t
ccacaggaagaatatagctaggacggtcaccggttgttatttcatcacgagggcggggattggacgttactgtgactgtgggcccgtcggcagacatgaatggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429978 - DNA, 5776 bp, Homo sapiens
  misc_feature (3460)..(3460): n is a, c, g, or t
  misc_feature (3469)..(3469): n is a, c, g, or t
  misc_feature (3479)..(3479): n is a, c, g, or t
  misc_feature (3531)..(3531): n is a, c, g, or t
  misc_feature (3534)..(3534): n is a, c, g, or t
  misc_feature (3544)..(3544): n is a, c, g, or t
  misc_feature (3565)..(3565): n is a, c, g, or t
  misc_feature (3571)..(3571): n is a, c, g, or t
  misc_feature (3586)..(3586): n is a, c, g, or t
  misc_feature (3598)..(3598): n is a, c, g, or t
  misc_feature (3647)..(3647): n is a, c, g, or t
  misc_feature (3666)..(3666): n is a, c, g, or t
  misc_feature (4093)..(4094): n is a, c, g, or t
  misc_feature (4139)..(4139): n is a, c, g, or t
  misc_feature (4166)..(4166): n is a, c, g, or t
  misc_feature (4178)..(4178): n is a, c, g, or t
  misc_feature (4191)..(4191): n is a, c, g, or t
  misc_feature (4200)..(4200): n is a, c, g, or t
  misc_feature (5553)..(5553): n is a, c, g, or t
  misc_feature (5651)..(5651): n is a, c, g, or t
  misc_feature (5773)..(5773): n is a, c, g, or t
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429979 - DNA, 6054 bp, Homo sapiens
  misc_feature (3738)..(3738): n is a, c, g, or t
  misc_feature (3747)..(3747): n is a, c, g, or t
  misc_feature (3757)..(3757): n is a, c, g, or t
  misc_feature (3809)..(3809): n is a, c, g, or t
  misc_feature (3812)..(3812): n is a, c, g, or t
  misc_feature (3822)..(3822): n is a, c, g, or t
  misc_feature (3843)..(3843): n is a, c, g, or t
  misc_feature (3849)..(3849): n is a, c, g, or t
  misc_feature (3864)..(3864): n is a, c, g, or t
  misc_feature (3876)..(3876): n is a, c, g, or t
  misc_feature (3925)..(3925): n is a, c, g, or t
  misc_feature (3944)..(3944): n is a, c, g, or t
  misc_feature (4371)..(4372): n is a, c, g, or t
  misc_feature (4417)..(4417): n is a, c, g, or t
  misc_feature (4444)..(4444): n is a, c, g, or t
  misc_feature (4456)..(4456): n is a, c, g, or t
  misc_feature (4469)..(4469): n is a, c, g, or t
  misc_feature (4478)..(4478): n is a, c, g, or t
  misc_feature (5831)..(5831): n is a, c, g, or t
  misc_feature (5929)..(5929): n is a, c, g, or t
  misc_feature (6051)..(6051): n is a, c, g, or t
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429980 - DNA, 5993 bp, Homo sapiens
  misc_feature (3677)..(3677): n is a, c, g, or t
  misc_feature (3686)..(3686): n is a, c, g, or t
  misc_feature (3696)..(3696): n is a, c, g, or t
  misc_feature (3748)..(3748): n is a, c, g, or t
  misc_feature (3751)..(3751): n is a, c, g, or t
  misc_feature (3761)..(3761): n is a, c, g, or t
  misc_feature (3782)..(3782): n is a, c, g, or t
  misc_feature (3788)..(3788): n is a, c, g, or t
  misc_feature (3803)..(3803): n is a, c, g, or t
  misc_feature (3815)..(3815): n is a, c, g, or t
  misc_feature (3864)..(3864): n is a, c, g, or t
  misc_feature (3883)..(3883): n is a, c, g, or t
  misc_feature (4310)..(4311): n is a, c, g, or t
  misc_feature (4356)..(4356): n is a, c, g, or t
  misc_feature (4383)..(4383): n is a, c, g, or t
  misc_feature (4395)..(4395): n is a, c, g, or t
  misc_feature (4408)..(4408): n is a, c, g, or t
  misc_feature (4417)..(4417): n is a, c, g, or t
  misc_feature (5770)..(5770): n is a, c, g, or t
  misc_feature (5868)..(5868): n is a, c, g, or t
  misc_feature (5990)..(5990): n is a, c, g, or t
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggccggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429981 - DNA, 2247 bp, Homo sapiens
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgactcgtggaaatgtccacgggatcctctagatcacctt

SEQ ID NO: 429982 - DNA, 904 bp, Homo sapiens
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggagtctccggacaagccctctcgggcctgttcgggccctgctgtggtctgcgtggggaactggtggcggcttaactaccgggtgcgccctccggtcccccctggctgggcgctccctcccggagcggccccttggtgtccttg

SEQ ID NO: 429983 - DNA, 2886 bp, Homo sapiens
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaataacatgtcgggggggggggggagggggggggggtgggggggggggag

SEQ ID NO: 429984 - DNA, 5812 bp, Homo sapiens
  misc_feature (3496)..(3496): n is a, c, g, or t
  misc_feature (3505)..(3505): n is a, c, g, or t
  misc_feature (3515)..(3515): n is a, c, g, or t
  misc_feature (3567)..(3567): n is a, c, g, or t
  misc_feature (3570)..(3570): n is a, c, g, or t
  misc_feature (3580)..(3580): n is a, c, g, or t
  misc_feature (3601)..(3601): n is a, c, g, or t
  misc_feature (3607)..(3607): n is a, c, g, or t
  misc_feature (3622)..(3622): n is a, c, g, or t
  misc_feature (3634)..(3634): n is a, c, g, or t
  misc_feature (3683)..(3683): n is a, c, g, or t
  misc_feature (3702)..(3702): n is a, c, g, or t
  misc_feature (4129)..(4130): n is a, c, g, or t
  misc_feature (4175)..(4175): n is a, c, g, or t
  misc_feature (4202)..(4202): n is a, c, g, or t
  misc_feature (4214)..(4214): n is a, c, g, or t
  misc_feature (4227)..(4227): n is a, c, g, or t
  misc_feature (4236)..(4236): n is a, c, g, or t
  misc_feature (5589)..(5589): n is a, c, g, or t
  misc_feature (5687)..(5687): n is a, c, g, or t
  misc_feature (5809)..(5809): n is a, c, g, or t
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429985 - DNA, 6365 bp, Homo sapiens
  misc_feature (4049)..(4049): n is a, c, g, or t
  misc_feature (4058)..(4058): n is a, c, g, or t
  misc_feature (4068)..(4068): n is a, c, g, or t
  misc_feature (4120)..(4120): n is a, c, g, or t
  misc_feature (4123)..(4123): n is a, c, g, or t
  misc_feature (4133)..(4133): n is a, c, g, or t
  misc_feature (4154)..(4154): n is a, c, g, or t
  misc_feature (4160)..(4160): n is a, c, g, or t
  misc_feature (4175)..(4175): n is a, c, g, or t
  misc_feature (4187)..(4187): n is a, c, g, or t
  misc_feature (4236)..(4236): n is a, c, g, or t
  misc_feature (4255)..(4255): n is a, c, g, or t
  misc_feature (4682)..(4683): n is a, c, g, or t
  misc_feature (4728)..(4728): n is a, c, g, or t
  misc_feature (4755)..(4755): n is a, c, g, or t
  misc_feature (4767)..(4767): n is a, c, g, or t
  misc_feature (4780)..(4780): n is a, c, g, or t
  misc_feature (4789)..(4789): n is a, c, g, or t
  misc_feature (6142)..(6142): n is a, c, g, or t
  misc_feature (6240)..(6240): n is a, c, g, or t
  misc_feature (6362)..(6362): n is a, c, g, or t
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgccttcctgctgcccaccccgcgtccctccagactgggtcccgtgctcccgtcccccagccctgaccaccctgggcagctgctgcatggggacagatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429986 - DNA, 6072 bp, Homo sapiens
  misc_feature (3756)..(3756): n is a, c, g, or t
  misc_feature (3765)..(3765): n is a, c, g, or t
  misc_feature (3775)..(3775): n is a, c, g, or t
  misc_feature (3827)..(3827): n is a, c, g, or t
  misc_feature (3830)..(3830): n is a, c, g, or t
  misc_feature (3840)..(3840): n is a, c, g, or t
  misc_feature (3861)..(3861): n is a, c, g, or t
  misc_feature (3867)..(3867): n is a, c, g, or t
  misc_feature (3882)..(3882): n is a, c, g, or t
  misc_feature (3894)..(3894): n is a, c, g, or t
  misc_feature (3943)..(3943): n is a, c, g, or t
  misc_feature (3962)..(3962): n is a, c, g, or t
  misc_feature (4389)..(4390): n is a, c, g, or t
  misc_feature (4435)..(4435): n is a, c, g, or t
  misc_feature (4462)..(4462): n is a, c, g, or t
  misc_feature (4474)..(4474): n is a, c, g, or t
  misc_feature (4487)..(4487): n is a, c, g, or t
  misc_feature (4496)..(4496): n is a, c, g, or t
  misc_feature (5849)..(5849): n is a, c, g, or t
  misc_feature (5947)..(5947): n is a, c, g, or t
  misc_feature (6069)..(6069): n is a, c, g, or t
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcctggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429987 - DNA, 5739 bp, Homo sapiens
  misc_feature (3423)..(3423): n is a, c, g, or t
  misc_feature (3432)..(3432): n is a, c, g, or t
  misc_feature (3442)..(3442): n is a, c, g, or t
  misc_feature (3494)..(3494): n is a, c, g, or t
  misc_feature (3497)..(3497): n is a, c, g, or t
  misc_feature (3507)..(3507): n is a, c, g, or t
  misc_feature (3528)..(3528): n is a, c, g, or t
  misc_feature (3534)..(3534): n is a, c, g, or t
  misc_feature (3549)..(3549): n is a, c, g, or t
  misc_feature (3561)..(3561): n is a, c, g, or t
  misc_feature (3610)..(3610): n is a, c, g, or t
  misc_feature (3629)..(3629): n is a, c, g, or t
  misc_feature (4056)..(4057): n is a, c, g, or t
  misc_feature (4102)..(4102): n is a, c, g, or t
  misc_feature (4129)..(4129): n is a, c, g, or t
  misc_feature (4141)..(4141): n is a, c, g, or t
  misc_feature (4154)..(4154): n is a, c, g, or t
  misc_feature (4163)..(4163): n is a, c, g, or t
  misc_feature (5516)..(5516): n is a, c, g, or t
  misc_feature (5614)..(5614): n is a, c, g, or t
  misc_feature (5736)..(5736): n is a, c, g, or t
actggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429988 - DNA, 3924 bp, Homo sapiens
  misc_feature (1608)..(1608): n is a, c, g, or t
  misc_feature (1617)..(1617): n is a, c, g, or t
  misc_feature (1627)..(1627): n is a, c, g, or t
  misc_feature (1679)..(1679): n is a, c, g, or t
  misc_feature (1682)..(1682): n is a, c, g, or t
  misc_feature (1692)..(1692): n is a, c, g, or t
  misc_feature (1713)..(1713): n is a, c, g, or t
  misc_feature (1719)..(1719): n is a, c, g, or t
  misc_feature (1734)..(1734): n is a, c, g, or t
  misc_feature (1746)..(1746): n is a, c, g, or t
  misc_feature (1795)..(1795): n is a, c, g, or t
  misc_feature (1814)..(1814): n is a, c, g, or t
  misc_feature (2241)..(2242): n is a, c, g, or t
  misc_feature (2287)..(2287): n is a, c, g, or t
  misc_feature (2314)..(2314): n is a, c, g, or t
  misc_feature (2326)..(2326): n is a, c, g, or t
  misc_feature (2339)..(2339): n is a, c, g, or t
  misc_feature (2348)..(2348): n is a, c, g, or t
  misc_feature (3701)..(3701): n is a, c, g, or t
  misc_feature (3799)..(3799): n is a, c, g, or t
  misc_feature (3921)..(3921): n is a, c, g, or t
cacaccagctcggggttgcacaccagctcggggttgcacaccagctcggggttgcacaccagctcggggttgcacaccagctcggggttgcacaccaactcggggttgcacaccagctcggggttgcacaccagctcggggttgcacaccagctcggggttccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcngtggcacgntcttggctcnctgcaacttctgcctcctgggttcaagcgattctcctgcctcagcctcccangtngctgggattncaggcgcttgccaccacgccnggctanttttttgtattttgngtagagactggntttcgccatcttggccagactggtcttgaactcctgacctcgtgatccncccacctcagcctcccaangtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacnngatgttgctatgttgcctaggctggtttcgaactcctggcctcangggatcctccctccttggccccgcaangtgctgggattncaggcgtgagccnccgtgcccngcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcngatcacttgaggtcaggagtttgagaccagcctgggcaacaaagtgagaccctgtctctactaaaaataacaaaaattagccgggcgtggtggtgggngcctgtaatcccagctcctcgggtggctgaggcatgagaatcacttgaacccaggaggcagaggtttcagtgagctgagatcacatcactgcactccagcctgggtgacagagtgagattcngtc

SEQ ID NO: 429989 - DNA, 2996 bp, Homo sapiens
ctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttcccccaaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaataagtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattta

SEQ ID NO: 429990 - DNA, 1221 bp, Homo sapiens
ctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaaatcaagtaattgttttcctatgaggaaaataaccatgagctgtatcatgctacttagcttttatgtaaatatttcttatgtctcctctattaagagtaattactaaaactctgtaatctccaaaatattgctatcaaattacacaccatgttttctatcattctcatagatctgccttataaacatttaaataaaaagtactatttaatgattta

SEQ ID NO: 429991 - DNA, 3328 bp, Homo sapiens
ctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttcccccaaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaataagtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacacaaaaaaaaaaaaaaaaaaaaaaaaaaaaaaaaaagaaaaaaaacaaaaaaaaaaagcccacaaaaagacaaaaatgcaaacgaaaaaaaaacagattgttggggggccgccgcgcccaccaaagaagaatggttaacacacaagacatgagggcggggcggcgccacagagtataggaagcaagctgagaagtcgtgtccacgaaagaaagctggctacactgggggggtttcctcacacacaaaaaaggcccggggaccagatgggttagaaacagcagatgcggaccaagggcatcacaagggacgagggaaaaatagcaccgagt

SEQ ID NO: 429992 - DNA, 3282 bp, Homo sapiens
ctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttcccccaaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaataagtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaactctgttgaaaaacaaaacccaaacaaaaagcaaaagagaaacaagacacaaatcaacacgacccgaagcgaaaccagacacacccaacaaaggaaacaaacacaaaacggccagaaaaagaacagcaaataacgcagcagggatacaaaaaaaccaagcacagaaagcgagcagaccagaaacacgtggataagcagcaaccgtacccgccgaaagcggccgaagaccgacaacctacccgcgagaacgagcagaaaacgcagaaccgacacgaccacgccaca

SEQ ID NO: 429993 - DNA, 2892 bp, Homo sapiens
  misc_feature (2837)..(2837): n is a, c, g, or t
  misc_feature (2840)..(2840): n is a, c, g, or t
  misc_feature (2846)..(2847): n is a, c, g, or t
  misc_feature (2851)..(2851): n is a, c, g, or t
ctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttcccccaaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaataagtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttcgcancgngtatgnnctcngcgagcgggggatcgtctatctacagtcggcctgcagggtt

SEQ ID NO: 429994 - DNA, 740 bp, Homo sapiens
ttgtgagtgatctagaggatcccggctcgcgagcagcccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattta

SEQ ID NO: 429995 - DNA, 737 bp, Homo sapiens
  misc_feature (13)..(13): n is a, c, g, or t
tacgaagtcgagntcggaccggctcgcgagcagcccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattta

SEQ ID NO: 429996 - DNA, 761 bp, Homo sapiens
ggctggagtgcgactctagagtagaccaggctcgcctagccgagcccaagcacagctcccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattta

SEQ ID NO: 429997 - DNA, 738 bp, Homo sapiens
gacactagaggagccccgccgcgttgagaatataccctgactgatctgatactgcaaggagtcttactatatactattgtgagacaggagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattta

SEQ ID NO: 429998 - DNA, 453 bp, Homo sapiens
ccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaaacttctgttttgaaatgttgtatacacgtggatttttttctcattaaataataattctagtatttga

SEQ ID NO: 429999 - DNA, 3736 bp, Homo sapiens
agcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatactgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctgcaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcta

SEQ ID NO: 430000 - DNA, 2989 bp, Homo sapiens
atgctggcagagtatagattgcattgaactgtatttaatcttctgatttcaagcactgagataaattgaggtcagggaacctctgagacagaagtaggctcttttatctgggtcgttttaaatgagatgctgtttttagattatacgtaactgaaaaaaagaggctcgtcttacttccatgtttttgtcccttctacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatactgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctgcaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcta

SEQ ID NO: 430001 - DNA, 3682 bp, Homo sapiens
agcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatactgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctgcaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcatggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcta

SEQ ID NO: 430002 - DNA, 1652 bp, Homo sapiens
acgtggggcaaacctcccctatagggaactgctgcatattaaagctgttcttgtccacatggcgcccctgaacgcgtttgagctctgcacgaagcgtttttgcccagcctccaaccccggaaggggccattttcaaagtgcccacaatgcggtttgtacctggagcccgttaatttttcgacaaccggcccctgagcgcgtcgggttccaaaacccaaggtgggtttttgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcta

SEQ ID NO: 430003 - DNA, 4316 bp, Homo sapiens
  misc_feature (3742)..(3742): n is a, c, g, or t
  misc_feature (3744)..(3744): n is a, c, g, or t
  misc_feature (3746)..(3746): n is a, c, g, or t
  misc_feature (3778)..(3778): n is a, c, g, or t
  misc_feature (3783)..(3783): n is a, c, g, or t
  misc_feature (3788)..(3788): n is a, c, g, or t
  misc_feature (3792)..(3792): n is a, c, g, or t
  misc_feature (3795)..(3795): n is a, c, g, or t
  misc_feature (3804)..(3804): n is a, c, g, or t
agcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatactgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctgcaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgctaaaaaanananaaaaaaaaaaaaaaaaaaaaaacaaaaaaaanaaaanaaaanaaanaanaaaaaaaanaaaaaaaaaaaagaagaaaaaaaaaaagaagatggggggccggcgccggtccaacacatatcttccccgcgcgggggggcgcccagcatatgccgcggccgacccccttttttgttggaagacggcgggcgcctccactcttaggaggggggcttcattatatatagcagcgcgacgcgggcggcggttgttaaaaaaacagcgtgagggggggaggacaacaaccagctcggatcgatggggagatatcttcttctgagaagagaagagccccacatctctcgggggggggggcgagacacaaatggggggacaacacaccacaccaaaagaaattaatacccactgctacgagagggaaatataacactatgacgcaggcatgatagaggtgggggaaccaaccccgcacgagaaatgacggcggcgtcaacaaaaagaaaatgttggttagccagaaatatttagtgaagaacaaattttttcgcggcgcgttataataacaaggggaa

SEQ ID NO: 430004 - DNA, 3857 bp, Homo sapiens
agcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatactgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctgcaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgctatctctataagaagttctactttactttgatagacatatataaatacactcgagggggggcccgtacccatttctcccttttgtggtcggattacaatccctgggcgaggtttacaacgtgg

SEQ ID NO: 430005 - DNA, 3670 bp, Homo sapiens
agcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatactgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctgcaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcta

SEQ ID NO: 430006 - DNA, 3567 bp, Homo sapiens
agcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatactgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctgcaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaatccttcttagcacatttaggcgtcttttagtcaatgaggaggctgagcctgtccctgcacctcccattgcaatggttggggcaataaccctcggtaatcctagctcagtgagtagcagggattgtcctccctacccaggagccatacattttggttgcaaagagccaggtcctgcgctcactctctgtacttccacagcctacccgtcttcctg

SEQ ID NO: 430007 - DNA, 3444 bp, Homo sapiens
agcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatactgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctgcaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaattttttttttcccttttttttttttttttttttttttctcgcatcccttttttaacttccttcttttttccctctcttttctcccattctc

SEQ ID NO: 430008 - DNA, 2968 bp, Homo sapiens
  misc_feature (2394)..(2394): n is a, c, g, or t
  misc_feature (2396)..(2396): n is a, c, g, or t
  misc_feature (2398)..(2398): n is a, c, g, or t
  misc_feature (2430)..(2430): n is a, c, g, or t
  misc_feature (2435)..(2435): n is a, c, g, or t
  misc_feature (2440)..(2440): n is a, c, g, or t
  misc_feature (2444)..(2444): n is a, c, g, or t
  misc_feature (2447)..(2447): n is a, c, g, or t
  misc_feature (2456)..(2456): n is a, c, g, or t
agcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatactgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctgcaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttaaaaaanananaaaaaaaaaaaaaaaaaaaaaacaaaaaaaanaaaanaaaanaaanaanaaaaaaaanaaaaaaaaaaaagaagaaaaaaaaaaagaagatggggggccggcgccggtccaacacatatcttccccgcgcgggggggcgcccagcatatgccgcggccgacccccttttttgttggaagacggcgggcgcctccactcttaggaggggggcttcattatatatagcagcgcgacgcgggcggcggttgttaaaaaaacagcgtgagggggggaggacaacaaccagctcggatcgatggggagatatcttcttctgagaagagaagagccccacatctctcgggggggggggcgagacacaaatggggggacaacacaccacaccaaaagaaattaatacccactgctacgagagggaaatataacactatgacgcaggcatgatagaggtgggggaaccaaccccgcacgagaaatgacggcggcgtcaacaaaaagaaaatgttggttagccagaaatatttagtgaagaacaaattttttcgcggcgcgttataataacaaggggaa

SEQ ID NO: 430009 - DNA, 1411 bp, Homo sapiens
agcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtgagtggcctttaccagcgcgtcctcagatgggatggtgccttattccacgggaaccgagagggtcccccacaaagcaggcaggccacaggtgcccatgctctttttcttctccttcccctgcctcttcctcagaggatgcctaggctcagggtgctgagccaccaacaaatatgcaacaagacaagttttgcgagtccatctgggtgccctaatttgtttaccagtcagggttccgtggcccactgcgctttccccagtgcgcgggctgctatcagaagaggcccctggaaggcgctgcgcccagggctgtcacagctcaaagctgtgttgggccttctttttgggagctgtccatagaggcaatggtctgttctttaggactggtctggatttgggccaggggagctgcctgttggcaaagcaggcaggcacacttgagaggcctcactgggtcttgcccct

SEQ ID NO: 430010 - DNA, 2121 bp, Homo sapiens
aggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaag

SEQ ID NO: 430011 - DNA, 4478 bp, Homo sapiens
aggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttgagtagcg

SEQ ID NO: 430012 - DNA, 2672 bp, Homo sapiens
aggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaagggagaggaagaaaagagagagagaaaagagcctcgtgcc

SEQ ID NO: 430013 - DNA, 3856 bp, Homo sapiens
aggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatccttttctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttgagtagcg

SEQ ID NO: 430014 - DNA, 3957 bp, Homo sapiens
aggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttgagtagcg

SEQ ID NO: 430015 - DNA, 3767 bp, Homo sapiens
aggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttgagtagcg

SEQ ID NO: 430016 - DNA, 3805 bp, Homo sapiens
ccggggatgcaggacatcacctcccagagcccagcagtagggagactggccgaggtgccaagggtgagcgaggtagcaagagccacccaaacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttgagtagcg

SEQ ID NO: 430017 - DNA, 4206 bp, Homo sapiens
aggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttgagtagcg

SEQ ID NO: 430018 - DNA, 2479 bp, Homo sapiens
  misc_feature (2122)..(2122): n is a, c, g, or t
  misc_feature (2269)..(2269): n is a, c, g, or t
aggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagnaaaaaaaaaaaaaaaaaaaaaaaaaaaaaagggggggggggcccatagaatagtaaaacacgcgggagcattcggcacccgtaaaaagttggggggaagccacacgagcattttctcgctggggagcccactatcttcgggaaaaanaaacgctaaccgctctggaatgattaaacctccgccaagaaagctctgccttgtgaagaaaataaccattagcaggggccggaggacagctcaattttcatgtctgttcggagaacgagattttccccacggggggttaccccccggggggaccgagacaggcgtggagggggaattcttcatatttacccaagtggggcccctccaaag

SEQ ID NO: 430019 - DNA, 1891 bp, Homo sapiens
gaagatgctagacaggctgtgttgaatcggacgagggtactaaaacgtcacctaaataggcccactgctgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttgagtagcg

SEQ ID NO: 430020 - DNA, 1410 bp, Homo sapiens
aggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaag

SEQ ID NO: 430021 - DNA, 856 bp, Homo sapiens
  misc_feature (824)..(824): n is a, c, g, or t
  misc_feature (841)..(841): n is a, c, g, or t
  misc_feature (850)..(850): n is a, c, g, or t
aaaaggctgtatatatctgctttgcctgtccaaggaactaagtctccagtgctgtcatagagatcaggatcaaatattaagtttacactgaaggatatagatgtcatattatatggcgtgttttacaatcagctctcacttctcaccatggggtaatgtgtacaaagggtgccgtttcttacaattttagtgtcattagtgttggatttttagaggttagatgtgacatattgttgtctccccccacccatcccgagttggtgcttctgctttcatgtgacagtaataattctgtactttaaaacctctgatttaaaatacaaagtcttgctttaaaaacttttgattctaaaggtattattgtgaaatggttctcattatagtgctataggattttcagtaaataaaatttaagaatagctgggtgtggtggcatcagcttgaggcaagaggatcccttaagccagggagattgaggccagcctgggcaactagtgagaccttgtctcttaaaaaaaaaaaaagactagttcctttttgtcttcagtactttccaagtgacctgttttttaccttcttctttctgatagattaacttaagtttatgggctgtgcacccccatccccattaaaggctaatattcctttttcagggtatgttagagcccaccaaggaaccactgaaaccactttctgctgcagaaaaaatagcttccatcggtcagacagccaccatgtcaccagatatgaacacatgtacatctgatcagttccagagtctctaccacccgtccagtttgactggagtaaggccaagttggggnccccccttttttaaaanccccttttnaaaaaa

SEQ ID NO: 430022 - DNA, 4061 bp, Homo sapiens
ccgctgcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccaggtgtaaattaattatttgaaagcaactgaacaatggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgtcgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430023 - DNA, 4313 bp, Homo sapiens
ccgctgcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccaggtaagcgccgccgctccgctcccctagctgcgccggggaaagagggtgcggggaccaggcccggcccagcagccagaccctcacccgggccgggagcatctgcccgccgcggagccgggagctgtgaggacggagctggctctgcgggcctgcgggctcccggctctgctctcttctgcggcgagtgcgggaacgccgctggtggcgcccgaagcgcacggccccctcctcgccatcccgggcaccggccgggtgtaaattaattatttgaaagcaactgaacaatggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgtcgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430024 - DNA, 4145 bp, Homo sapiens
ccgctgcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccaggtgtaaattaattatttgaaagcaactgaacaatggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgtcgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatgctagtggaggttccactcttctgaaccttgatttctttgggcccgtggatgacagtagctctagcagcagcaccacaatcccaggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430025 - DNA, 4007 bp, Homo sapiens
ccgctgcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccaggtgtaaattaattatttgaaagcaactgaacaatggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgtcgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430026 - DNA, 2094 bp, Homo sapiens
ccgctgcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430027 - DNA, 4000 bp, Homo sapiens
ccgctgcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccaggtgtaaattaattatttgaaagcaactgaacaatggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgtcgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430028 - DNA, 2124 bp, Homo sapiens
aaaaggctgtatatatctgctttgcctgtccaaggaactaagtctccagtgctgtcatagagatcaggatcaaatattaagtttacactgaaggatatagatgtcatattatatggcgtgttttacaatcagctctcacttctcaccatggggtaatgtgtacaaagggtgccgtttcttacaattttagtgtcattagtgttggatttttagaggttagatgtgacatattgttgtctccccccacccatcccgagttggtgcttctgctttcatgtgacagtaataattctgtactttaaaacctctgatttaaaatacaaagtcttgctttaaaaacttttgattctaaaggtattattgtgaaatggttctcattatagtgctataggattttcagtaaataaaatttaagaatagctgggtgtggtggcatcagcttgaggcaagaggatcccttaagccagggagattgaggccagcctgggcaactagtgagaccttgtctcttaaaaaaaaaaaaagactagttcctttttgtcttcagtactttccaagtgacctgttttttaccttcttctttctgatagattaacttaagtttatgggctgtgcacccccatccccattaaaggctaatattcctttttcagggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430029 - DNA, 1475 bp, Homo sapiens
cctgcatgttcaagtgtgtgtcttacccctttttacacataacccctcctcccttggcttaccttctgtgtggctgcctaccaacacggtcactgaatttcaagctagtggaggttccactcttctgaaccttgatttctttgggcccgtggatgacagtagctctagcagcagcaccacaatcccaggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430030 - DNA, 2063 bp, Homo sapiens
aaaaggctgtatatatctgctttgcctgtccaaggaactaagtctccagtgctgtcatagagatcaggatcaaatattaagtttacactgaaggatatagatgtcatattatatggcgtgttttacaatcagctctcacttctcaccatggggtaatgtgtacaaagggtgccgtttcttacaattttagtgtcattagtgttggatttttagaggttagatgtgacatattgttgtctccccccacccatcccgagttggtgcttctgctttcatgtgacagtaataattctgtactttaaaacctctgatttaaaatacaaagtcttgctttaaaaacttttgattctaaaggtattattgtgaaatggttctcattatagtgctataggattttcagtaaataaaatttaagaatagctgggtgtggtggcatcagcttgaggcaagaggatcccttaagccagggagattgaggccagcctgggcaactagtgagaccttgtctcttaaaaaaaaaaaaagactagttcctttttgtcttcagtactttccaagtgacctgttttttaccttcttctttctgatagattaacttaagtttatgggctgtgcacccccatccccattaaaggctaatattcctttttcagggtatgttagagcccaccaaggaaccactgaaaccactttctgctgcagaaaaaatagcttccatcggtcagacagccaccatgtcaccagatatgaacacatgtacatctgatcagttccaggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430031 - DNA, 1712 bp, Homo sapiens
gctgtctgtatcccaacaggctgagactgggtcttctgagctgagagctttctctcctggaattccccactgggaataaagagagcctgaggttaaaatgacttagtctttccctgggcacactttgtttcaggctgaggtagttttagcgggtggaggggcagggaaaaacccagttaggtggagtgttactaaggcttcagatttatatttctgtttagtaacattttaaaattatgcctgggtagatgcttctagcctaatgtaaaggctagaaagtacacgagctgtctaggtgtgcatgtgagtatctgtgtgtgcatgcctagctttaatgaacataaataggccgcatgtcactcttcatgagatttggcatttggcacaggaagcatactgcacaaaagtattacaagattcaggaactagcagaggaaaaaatactcaagtccccacagattgctaactgtctaccttgagagtggattgtctcccattttacctacagcaaagtcacattaacacacttgtctttttttcatttgtcagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430032 - DNA, 1230 bp, Homo sapiens
gatttgctggtgcagtacaactaggcttaatagggacatgtctacagtagagaagacaagccatctctaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430033 - DNA, 1014 bp, Homo sapiens
agtaaaggcagtcttcagaaagggcaactgggtgtgccacaccataagtgacttgctgaaagccatgagaaattatacctgccctcaaggaactcatagttcccagggagtttcagaccccaagaccgattacacccttcctactcagaaaaggccgttacattggtatgaccccgagacatccacataacccgggtttgacgggagaagttccccgaagctgcacccactgccacccccaagccatcctagcacctgatgagctaattaatccccattattattgatgttgtgtaaactgattaatccgtttaccccaaaaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagcatacctgctctaattcacaaagacaaacaaagaaaatccaggt

SEQ ID NO: 430034 - DNA, 466 bp, Homo sapiens
taaataaaatttaagaatagctgggtgtggtggcatcagcttgaggcaagaggatcccttaagccagggagattgaggccagcctgggcaactagtgagaccttgtctcttaaaaaaaaaaaaagactagttcctttttgtcttcagtactttccaagtgacctgttttttaccttcttctttctgatagattaacttaagtttatgggctgtgcacccccatccccattaaaggctaatattcctttttcagggtatgttagagcccaccaaggaaccactgaaaccactttctgctgcagaaaaaatagcttccatcggtcagacagccaccatgtcaccagatatgaacacatgtacatctgatcagttccaggtaaaaatatctatatgtgtataaatatgtttatgcgtgtatatacacatatatccacacatactgcctttttccttcatttatgactgt

SEQ ID NO: 430035 - DNA, 438 bp, Homo sapiens
tttaaaagacccagggatttcaactagaaaattgtattgaataaatctatttctttcccaaatgaaaagtgacaaagttaaggcccttagttagaaaagtatcacgatggcaatttcttttctaattagtgaaaaatgtgccattggcctttctctgaaatgtaactagtattatttttcgtattcaggagggaccttgtggtggcagcccagaattttttctgtgccggctgtggaactccagtagagcctagtaagtacggataatggatcgcctgcttatgatgtgatgacaaggtccagaatagcaaagtagggcagcgcattgcttgtgtgagagatgcctttgatgagaagttgttataagagcttcagagaagtttgccctccttttcatgaggagtccatcatgactgacaaggctgtgtgatcaactag

SEQ ID NO: 430036 - DNA, 287 bp, Homo sapiens
tcggccgccgggattccttcggccgccgggattccttcggccgccgggattccttcggccgccgggattccttcggccgccgggattcctccagggcctttgctgcagcttatatgttcactagtaatctggcctgtgcctaccttttaatcccagctggaaaatctcagtaagaatgatggtaagctttgagattggtatctcttcccttaaatgtttttggaaattgattttattgtttgtacctaagtatctctgattcaaaggaccccctttgtgacagtggc

SEQ ID NO: 430037 - DNA, 2863 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430038 - DNA, 3682 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaac

SEQ ID NO: 430039 - DNA, 3133 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430040 - DNA, 2727 bp, Homo sapiens
tccaggtgaagcagccagcagaggtcagagagagacagctcacgttccggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430041 - DNA, 2746 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430042 - DNA, 2756 bp, Homo sapiens
gttggggcttatggatgctggatgaagataagtgagagaggtttacagggacagcatcatgtcaggccttgagggcaagaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430043 - DNA, 2630 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctgggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430044 - DNA, 1891 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtcaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430045 - DNA, 1903 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagaggtatctgtcttctgtgcacagtgcacatagacccttgggctgtcacctctgaggcagtgtgaaacctaggcctctgacattctgggcccactttagctagttccagtgatttgttcccatgaatctaggagagtatcacctagaaatgaaacaatcacccccaaagtttctatagtgttttacaatatataaaaggcttttgtatgcattttcatttaatcctcatttcagttaaacaggttgggtgaattttatgtatgcatgtgtgtgtatatttatgtttttgttgttgttgtttttgagaccgagttttgctcttgtcacccagggaggcagaggttgcagtgagctgagattgcaccagtgcactccagcttgggtgacagagcgagactcgatctcaaaaccaacaaaagaaatgtaacaaaatgtaaataaaaatatgtttgttctct

SEQ ID NO: 430046 - DNA, 3017 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430047 - DNA, 2906 bp, Homo sapiens
tgtcctgaagtctcttgtttgtccagggcctttgctgcagcttatatgttcactagtaatctggcctgtgcctaccttttaatcccagctggaaaatctcagtaagaatgatgataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430048 - DNA, 2890 bp, Homo sapiens
cccctgcgaacttgatgctgtccgcttggaaaacgtggagaactttcagaggaggggttatttcgccttgagtgaaaattaagactcaaaggaaaagataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430049 - DNA, 2494 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430050 - DNA, 1520 bp, Homo sapiens
gttccttttgctacactgcagtttgcaatttccatcttccaaatccaggagtattttgggaaggttttgtttttctgacgtctgttccacaagagcagagctcatgaatggccatgatttaattccccaagtctctgctggagccttcccagctgtcatgaggttgagtatggctttatcatcatgaaacaagtcatcagagtctttgaatcttgcgtaggaattggaagtcggggtataccaggataggttttcagcaccaggtgtggcactcaccctccggtatgcttggcagagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaaaaaaaagcaatgcgaaggtgctaatcctgacgctcgtggtggccgcctgcggcttcgtcctctggagcagcaatgggcgacaaaggaagaacgaggccctcgccccaccgttgctggacgccgaacccgcg

SEQ ID NO: 430051 - DNA, 1622 bp, Homo sapiens
cgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtaattttagtaggtgacctccctcattcctctctgttcacacccttgcttcgccttgctctaaagcctgccttgttgtcttccccatgggacaatgcattgcctcatctaatattgtcagcagcccagccatctgggcggtcacaacaggtgaaatcaaatattggctttctccttagactgcagagaattgttatctttttagcttaatgtagttgataatcagtgccatgtgccatctttaagctggcgtctgccttcaggaacttagagctcattaaattgtctacaggggagagcatcggaagcactctcaagtcagtgtggaggttggaggtgtttccagacagccacggggtctgcatttcacaccagtacctagtaggtggtgaagtcacttcacttgttatatttacctgtatagaatctgacaggaaaatggtaagatttttaaacaataactacagtttcccctgaagactatacaaaacccctttttattaaaacaagggctctcactgctatgaagtaatgtacatattcctaagaccctaaaattcctaaaaattggataatccgtgcgaagtactactcaagagtcaataaattagctattattgttata

SEQ ID NO: 430052 - DNA, 2067 bp, Homo sapiens
  misc_feature (4)..(4): n is a, c, g, or t
ggcncgagcgcgcgctgtgcagaggtagccgtggaaggcggctcccggcgctggcaggcggccgcccccagacccgcagtgccatgcgcaggtgcttgcgcccgttcttcagttagcgatcttttggttaggaacgcaggtggacctgcttgtttggccatttgcattccggagtctgcctctggccgcggcctgtgggatggtcgttgggcttcctcgttcgttcagatgcttcgcgatttagcttgctacggacgccagcagccagcgcttgcagagagcgcggtccactctgctctgagggctttacaggggcaggcgctgctatttcccggcattttcctcgaggaaataggcacagagaggttagtcgcgcgctgaaggtcacacagccggcgggtgggcaagtcaggatctggccctgggcctgcagccctggagcttgggccccagggcgcgccctgcctctgtggctctgcctgtggatcgcagtcgcaggctcgctccttgtggggcctctagcctcccggcctggggctaatcctgggaggtgcgtggcatggggcactggctttgctgatgaggagaccagacttcagaggccgtgtcacctggcctgggccgcacagctggtgcatgccaagctcgcgtgcagacgaagctccagaggcctggctgtcaggagggttcctccccgaggacacacacgcaacctcctggaccgccaggctttagacttttaaaacttccatatgcaggaaaccccacaggacgcagccagcatctcgggtcatgggtgcacctgtcaccgcagtcctgggctaaacagtgaacaggagctctgtgtctctgtggtcgttacagttgtagtgaatgttccctgggagagtcctcttcagaagatatttgcggtattttcaacaaaggactctccaggatggaggagcaactacaagtcaggaaggaaaaggctgacaacccagttttttaaaaaacgggcaaaggacgtgaacagacaccatgcaatggcccagagtgcacaaatcatcatttctcccaggaatggggtgcccgagcccccaggcggctgaacttgagacttgtcacgtagtgttggtggaatgcagagcagctggagatcacctgctgcaggtgggtgcgtaactccgcacggccaagccgtttggaaagctgtagcatatgcatgagagtccggaaagttccgagagaaagtgtgtggatgcacccgccaaggacacacccaccgaggccacagctgcgatttcatagtgtgggaccccactggcaaagacacgctggctgctgtggccgtggtttctgtcccagccgtctgtttccatagaaaaagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgacccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430053 - DNA, 174 bp, Homo sapiens
agagaaaaaaagcaaacatttccttaaataccaatgctgtttctggttgtgatctctccatctcaggtgaatgtgtacgtgcttggaaagacgtttcttctcttggcaagagagctctgcatcaatgcgccggccataggtaggcatctgggtgagatgctggggtgtccggca

SEQ ID NO: 430054 - DNA, 3976 bp, Homo sapiens
gggctgagtcctcaccccaggcctcgctcgccgctggagaccgcgctcactatccgaggaggaccctcctctgccccgcgtccagctttagtccccgactgcgttcatcgccaagggcccgcccactgccttaggtcgcgtcgccagccttgggtcccgtcgccagccttgggtcccgtccccggctgcactcaccgcgaggccccacccttagctctagtccccggtgtcgcccaccgacgaggccccgccccaaactccagtcccgggctgcgctcaccgccgtggccccgcccccaagcggccgcgtcgactcggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttgcccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430055 - DNA, 4123 bp, Homo sapiens
  misc_feature (4)..(4): n is a, c, g, or t
ggcncgagcgcgcgctgtgcagaggtagccgtggaaggcggctcccggcgctggcaggcggccgcccccagacccgcagtgccatgcgcaggtgcttgcgcccgttcttcagttagcgatcttttggttaggaacgcaggtggacctgcttgtttggccatttgcattccggagtctgcctctggccgcggcctgtgggatggtcgttgggcttcctcgttcgttcagatgcttcgcgatttagcttgctacggacgccagcagccagcgcttgcagagagcgcggtccactctgctctgagggctttacaggggcaggcgctgctatttcccggcattttcctcgaggaaataggcacagagaggttagtcgcgcgctgaaggtcacacagccggcgggtgggcaagtcaggatctggccctgggcctgcagccctggagcttgggccccagggcgcgccctgcctctgtggctctgcctgtggatcgcagtcgcaggctcgctccttgtggggcctctagcctcccggcctggggctaatcctgggaggtgcgtggcatggggcactggctttgctgatgaggagaccagacttcagaggccgtgtcacctggcctgggccgcacagctggtgcatgccaagctcgcgtgcagacgaagctccagaggcctggctgtcaggagggttcctccccgaggacacacacgcaacctcctggaccgccaggctttagacttttaaaacttccatatgcaggaaaccccacaggacgcagccagcatctcgggtcatgggtgcacctgtcaccgcagtcctgggctaaacagtgaacaggagctctgtgtctctgtggtcgttacagttgtagtgaatgttccctgggagagtcctcttcagaagatatttgcggtattttcaacaaaggactctccaggatggaggagcaactacaagtcaggaaggaaaaggctgacaacccagttttttaaaaaacgggcaaaggacgtgaacagacaccatgcaatggcccagagtgcacaaatcatcatttctcccaggaatggggtgcccgagcccccaggcggctgaacttgagacttgtcacgtagtgttggtggaatgcagagcagctggagatcacctgctgcaggtgggtgcgtaactccgcacggccaagccgtttggaaagctgtagcatatgcatgagagtccggaaagttccgagagaaagtgtgtggatgcacccgccaaggacacacccaccgaggccacagctgcgatttcatagtgtgggaccccactggcaaagacacgctggctgctgtggccgtggtttctgtcccagccgtctgtttccatagaaaaagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttgcccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430056 - DNA, 3119 bp, Homo sapiens
  misc_feature (4)..(4): n is a, c, g, or t
ggcncgagcgcgcgctgtgcagaggtagccgtggaaggcggctcccggcgctggcaggcggccgcccccagacccgcagtgccatgcgcaggtgcttgcgcccgttcttcagttagcgatcttttggttaggaacgcaggtggacctgcttgtttggccatttgcattccggagtctgcctctggccgcggcctgtgggatggtcgttgggcttcctcgttcgttcagatgcttcgcgatttagcttgctacggacgccagcagccagcgcttgcagagagcgcggtccactctgctctgagggctttacaggggcaggcgctgctatttcccggcattttcctcgaggaaataggcacagagagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttgcccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430057 - DNA, 2709 bp, Homo sapiens
gtgggctgtcttcattgtcttaacgatgtctttcaaagggcagttcttaattttttggaaatccgttttatcagtgttttatggattctgcttttagaaccattagaaatgtttgccttatccaaggtcacaaagtttttcttttacgtttttgtctgaaatgtctgtactttaactctccccctaggtctgtgatctgctttgagctaacttccgcgtgcagtgcgaggtgtgggcttggagggggctcccgatttcctttttggccaccctggaaccggcccagggggggggggggggggggggggggggggggggggggggggggggggggggggggggcaccgtgcactgacagccgttctatgggttacctggcagcttggtagcatgttttttgtcacaaaagcgggcaccctggccctctgcctggttaacaggtggattgtgtacacctaggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttgcccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430058 - DNA, 2702 bp, Homo sapiens
gtgggctgtcttcattgtcttaacgatgtctttcaaagggcagttcttaattttttggaaatccgttttatcagtgttttatggattctgcttttagaaccattagaaatgtttgccttatccaaggtcacaaagtttttcttttacgtttttgtctgaaatgtctgtactttaactctccccctaggtctgtgatctgctttgagctaacttccgcgtgcagtgcgaggtgtgggctgaggctcgttctttggcacctgaccgccaggcaccgtgcactgacagccgttctatgggttacctggcagcttggtagcatgttttttgtcacaaaagcgggcaccctggccctctgcctggttaacaggtggattgtgtacacctaggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggcgcgaccttagcatgccccggtgtgcgaaggctaaaagccagccccacttccctgtgctcgcccagtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttgcccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430059 - DNA, 1906 bp, Homo sapiens
gggctgagtcctcaccccaggcctcgctcgccgctggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttgcccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430060 - DNA, 1589 bp, Homo sapiens
aaagatagctagtcgagccgcgtgttatcggcgagggacctgctggacagttgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttgcccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430061 - DNA, 3157 bp, Homo sapiens
gggctgagtcctcaccccaggcctcgctcgccgctggagaccgcgctcactatccgaggaggaccctcctctgccccgcgtccagctttagtccccgactgcgttcatcgccaagggcccgcccactgccttaggtcgcgtcgccagccttgggtcccgtcgccagccttgggtcccgtccccggctgcactcaccgcgaggccccacccttagctctagtccccggtgtcgcccaccgacgaggccccgccccaaactccagtcccgggctgcgctcaccgccgtggccccgcccccaagcggccgcgtcgactcggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430062 - DNA, 2912 bp, Homo sapiens
gggctgagtcctcaccccaggcctcgctcgccgctggagaccgcgctcactatccgaggaggaccctcctctgccccgcgtccagctttagtccccgactgcgttcatcgccaagggcccgcccactgccttaggtcgcgtcgccagccttgggtcccgtcgccagccttgggtcccgtccccggctgcactcaccgcgaggccccacccttagctctagtccccggtgtcgcccaccgacgaggccccgccccaaactccagtcccgggctgcgctcaccgccgtggccccgcccccaagcggccgcgtcgactcggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgcctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430063 - DNA, 2484 bp, Homo sapiens
gggctgagtcctcaccccaggcctcgctcgccgctggagaccgcgctcactatccgaggaggaccctcctctgccccgcgtccagctttagtccccgactgcgttcatcgccaagggcccgcccactgccttaggtcgcgtcgccagccttgggtcccgtcgccagccttgggtcccgtccccggctgcactcaccgcgaggccccacccttagctctagtccccggtgtcgcccaccgacgaggccccgccccaaactccagtcccgggctgcgctcaccgccgtggccccgcccccaagcggccgcgtcgactcggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaa

SEQ ID NO: 430064 - DNA, 1485 bp, Homo sapiens
gggctgagtcctcaccccaggcctcgctcgccgctggagaccgcgctcactatccgaggaggaccctcctctgccccgcgtccagctttagtccccgactgcgttcatcgccaagggcccgcccactgccttaggtcgcgtcgccagccttgggtcccgtcgccagccttgggtcccgtccccggctgcactcaccgcgaggccccacccttagctctagtccccggtgtcgcccaccgacgaggccccgccccaaactccagtcccgggctgcgctcaccgccgtggccccgcccccaagcggccgcgtcgactcggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtagacagcctccgtcctgcatctttccccacctggggttgtgacctgggggttgtgaccagggttgtgaccggggtgtaccccaggtgcctccacgcatctcagtggccggtctgtgctgcctgcccagtcaggaagttttggtctgtaggatgaggggccttcatgacatgggggtcacagtccgagacttgtgggagtgtgggtctccatggcaggagggcacctgccaatgctgggcacggttgggtgttagctaggcctgggtgaacagtgaacttttgtcctacacaaaggagattattttcaattaaaaaatttttttgtgagtaaaaa

SEQ ID NO: 430065 - DNA, 2298 bp, Homo sapiens
aggcggcggcggcggcggcggcggcggcggctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttgaacctgtcacctggcctgccaccctcctgcgcaggccatgcatggctcccgagtacagtagtatctgcttaggtgccaggcatgtcctaggctctgggtgcagtagtgagcaggacgggtaccatgctgccctgaagggggccacagcctgggtggaaggcagacctgaatcacaacgggccagctctagtaatacgaaggtgaggtctgggatgctgcgtgcggcgcgacgacaggaggtatgacctgggtggggtcagggaaagtcttagctgagaactaagagatgagggaggcacaaactctgcacgggggaactgtgtgtgcaaaggtgagctgggggcgagaaaggcctctgtggccgtcatcggcactagcgggttgggggtggtggtggggtgctggcagcctcaggagcgatcgctcccctggagagggtgattgagtgtggagatcaccggggccgccgcgggccgtctgcacttctgttccaggtttttctggcattttctgttccaggtttcttccacccacgagcactttattctcctccgagacccccttttcttccccttcctctctcccccaccagggggcgcgcttaaatttccagacagagaccagaaggaaggtttagaaagaaaagaacacttgcccagggcagctttgccctccaagaggctccctcctgtctctaagtcaattccacccctcctcgaagtcccggcttccacccctctcctcagagtcccggcgtttacctcgtggtgtgtttgccttgggcctttcatgccccggctgcacacatcgtctgtgaattgtggctgttcactcccgaggatgtgtcctagactccgggtcgcgtggatctaccctctagtttacttgctcgggagaagaaactgactcgttttatttagtgcctatttagcgagcccagagtaacgtacatttgtgctgttttcaattttgtgctatcgcaaatcacaaaaaaactgttatcaattcacattcatcatcagcacgagacccatttccttgtgctcctgccagctcaggatattatgtttcttttttcatttttgccagtctgttaagtaaaatgtcatatgcgtttgttttaatttgc

SEQ ID NO: 430066 - DNA, 2224 bp, Homo sapiens
gcttccaggagttcccaccagtaggagctcccacccaaaagaatggggtcactggcagcttttgaaccagctgggcactggctggagaggctgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttgaacctgtcacctggcctgccaccctcctgcgcaggccatgcatggctcccgagtacagtagtatctgcttaggtgccaggcatgtcctaggctctgggtgcagtagtgagcaggacgggtaccatgctgccctgaagggggccacagcctgggtggaaggcagacctgaatcacaacgggccagctctagtaatacgaaggtgaggtctgggatgctgcgtgcggcgcgacgacaggaggtatgacctgggtggggtcagggaaagtcttagctgagaactaagagatgagggaggcacaaactctgcacgggggaactgtgtgtgcaaaggtgagctgggggcgagaaaggcctctgtggccgtcatcggcactagcgggttgggggtggtggtggggtgctggcagcctcaggagcgatcgctcccctggagagggtgattgagtgtggagatcaccggggccgccgcgggccgtctgcacttctgttccaggtttttctggcattttctgttccaggtttcttccacccacgagcactttattctcctccgagacccccttttcttccccttcctctctcccccaccagggggcgcgcttaaatttccagacagagaccagaaggaaggtttagaaagaaaagaacacttgcccagggcagctttgccctccaagaggctccctcctgtctctaagtcaattccacccctcctcgaagtcccggcttccacccctctcctcagagtcccggcgtttacctcgtggtgtgtttgccttgggcctttcatgccccggctgcacacatcgtctgtgaattgtggctgttcactcccgaggatgtgtcctagactccgggtcgcgtggatctaccctctagtttacttgctcgggagaagaaactgactcgttttatttagtgcctatttagcgagcccagagtaacgtacatttgtgctgttttcaattttgtgctatcgcaaatcacaaaaaaactgttatcaattcacattcatcatcagcacgagacccatttccttgtgctcctgccagctcaggatattatgtttcttttttcatttttgccagtctgttaagtaaaatgtcatatgcgtttgttttaatttgc

SEQ ID NO: 430067 - DNA, 1050 bp, Homo sapiens
aggcggcggcggcggcggcggcggcggcggctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccacctt

SEQ ID NO: 430068 - DNA, 1204 bp, Homo sapiens
  misc_feature (1186)..(1186): n is a, c, g, or t
aggcggcggcggcggcggcggcggcggcggctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttaaaaaaaaaacaaagganaaaaaaaagtcgtatcga

SEQ ID NO: 430069 - DNA, 1207 bp, Homo sapiens
aggcggcggcggcggcggcggcggcggcggctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttaaaaaaaaaaataataatagttagataaggtcgtatcga

SEQ ID NO: 430070 - DNA, 970 bp, Homo sapiens
  misc_feature (952)..(952): n is a, c, g, or t
aggcggcggcggcggcggcggcggcggcggctcctcagagtccggctcaggctccggctgcggctccagcccgcgatgccccattccgtgaccctgcgcgggccttcgccctggggcttccgcctggtgggcggccgggacttcagcgcgcccctcaccatctcacgggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttaaaaaaaaaacaaagganaaaaaaaagtcgtatcga

SEQ ID NO: 430071 - DNA, 155 bp, Homo sapiens
gatccctcaaatctcacccagtcccactctgacccctgacacttgatccttgggtcttagctggttgcattctgactcataagccttaccagaccccaagtccacagggtgaaggctggaactgcatcccttcctcctctatttctttctccctc

SEQ ID NO: 430072 - DNA, 1168 bp, Homo sapiens
aggcggcggcggcggcggcggcggcggcggctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccacctt

SEQ ID NO: 430073 - DNA, 1967 bp, Homo sapiens
tgtaggacaggagttacgttttttgagttcccagccatgggcctacccagtacccaccacagttcaggaaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttgaacctgtcacctggcctgccaccctcctgcgcaggccatgcatggctcccgagtacagtagtatctgcttaggtgccaggcatgtcctaggctctgggtgcagtagtgagcaggacgggtaccatgctgccctgaagggggccacagcctgggtggaaggcagacctgaatcacaacgggccagctctagtaatacgaaggtgaggtctgggatgctgcgtgcggcgcgacgacaggaggtatgacctgggtggggtcagggaaagtcttagctgagaactaagagatgagggaggcacaaactctgcacgggggaactgtgtgtgcaaaggtgagctgggggcgagaaaggcctctgtggccgtcatcggcactagcgggttgggggtggtggtggggtgctggcagcctcaggagcgatcgctcccctggagagggtgattgagtgtggagatcaccggggccgccgcgggccgtctgcacttctgttccaggtttttctggcattttctgttccaggtttcttccacccacgagcactttattctcctccgagacccccttttcttccccttcctctctcccccaccagggggcgcgcttaaatttccagacagagaccagaaggaaggtttagaaagaaaagaacacttgcccagggcagctttgccctccaagaggctccctcctgtctctaagtcaattccacccctcctcgaagtcccggcttccacccctctcctcagagtcccggcgtttacctcgtggtgtgtttgccttgggcctttcatgccccggctgcacacatcgtctgtgaattgtggctgttcactcccgaggatgtgtcctagactccgggtcgcgtggatctaccctctagtttacttgctcgggagaagaaactgactcgttttatttagtgcctatttagcgagcccagagtaacgtacatttgtgctgttttcaattttgtgctatcgcaaatcacaaaaaaactgttatcaattcacattcatcatcagcacgagacccatttccttgtgctcctgccagctcaggatattatgtttcttttttcatttttgccagtctgttaagtaaaatgtcatatgcgtttgttttaatttgc

SEQ ID NO: 430074 - DNA, 1493 bp, Homo sapiens
aggcggcggcggcggcggcggcggcggcggctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcgggtaagacgcctgccacctgtccccatctgccttcccactccctgcagtgcccaggttgccccctagcgaccccacgtcccgcctcgcagtcacctgccctcttcggtctctgcggcccggtcccacgcccttgctacaaccttgctacgccctggcttcccgattccctctccaccccctgtcgctgcccctcaccccacgcccgccaaacccgttccccagtctcgggtgccgatggcccgtctggcgcccaaccaaacaccccgcagaaatggagttctgacctcctcaccccgttcatgccacctacgctccgggtttcaggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccacctt

SEQ ID NO: 430075 - DNA, 1007 bp, Homo sapiens
aggcggcggcggcggcggcggcggcggcggctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcgcggatggccggctgggggccggaactagccacggcagaagcgggggcccgtgaaggcgcagggtgcgaagagcccgtgcgccggtcggggccacgtaggcggcaagctccaccagggtagggaggatgggcaaacacaggggacttgcaacggtcagtaaacccggggacgcccggactggggcccacagaggcagcgcgccaggtaagggggaacgcaaaaacggcgcccagcatagtggctgcggcggcgggtgggggta

SEQ ID NO: 430076 - DNA, 597 bp, Homo sapiens
atggcgcagctatctagtagaaagccacggtcaccgtgggttgacagtggcttagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430077 - DNA, 963 bp, Homo sapiens
ccccccccccaggctacttcggctaggtacgaggctgcgtggtgtgaatcggccgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaacggttatgaaccttatagattaacttaacgggaacctgggcaaatgggaaagccaaactatcacctaggctggagaatgcccagatgacgcagcgacaaggcgccaagcggacctggaattgtcacaggaaacgtaaaaaacaaacgtacaa

SEQ ID NO: 430078 - DNA, 386 bp, Homo sapiens
gtatcatttgtttctagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatcttttggtggcagggatagaagttacctcaatatctttaggttgtgacagaaagtattattagataagagcctgactagacaggaattctggcggggatcc

SEQ ID NO: 430079 - DNA, 699 bp, Homo sapiens
tggatgcgagggtttatttctggctctctcctcgtttcattggtccatacgtttgtcattatgccagtaccacactgaattgatcactgtagctttttagtgagtgagtcctccagctttgctgttcttcttttaagattgttttggttgttccagaattcaatcccttgggaaccaatatgaacttgaggatggtttttgatatcttaacaatactaagtcttccaaactatgaacatgggatgtgtttccctatatccttgtccgcttcagtgtcttcttaaatgctttgttatagattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcaggtgaggtttgaagaccagcagatgttggtagaattttgtaagatataatttgctttgtgttttatcccaaattcctaattttgtatgctgtattagtgaacagaccttggtttacatatgggggaaaaaaatctttgtacctcctcctgctccggcagcattgtgtcaacgcggacagattcaactcggagccagccttggacttgtgtccatcacctgtagaatgaac

SEQ ID NO: 430080 - DNA, 3920 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430081 - DNA, 4080 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaactaaaaaaaggggggggttaaaattaccctgaggggcagttacctgtcccgtttggtgaagggccaaggggggtaaaaaagcggggggttaaagtgtggaaaggctggttttggagacctctgtgcagggccacgaacgggaaagttgagtttgttgtaacag

SEQ ID NO: 430082 - DNA, 4043 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaactaaaaaaaatcaacccatcacatcccacaacacccccgcacaagacctaactccatacacaacaagcggctgctctcccggacccacatccaaaagctcagactaagcggcacgagaccatctac

SEQ ID NO: 430083 - DNA, 4324 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaactataaaaaagagaagaaaagaaacaacaaaacaaacaaaaacattgtgtgtggggcggcctgtggggcccgccgggaaaagagttttttgagagaacccatttctgttgtgggggcgcggggccccagtggggttgagggcgacaccacgtggccccatacgcggtggttgaccagagggaaaaactccgcgggccaatgacagcaagacgcgcgggggtatctctgcacgccattcaaaaaacgcgccgccggggtgggaacaccacgaagggttttcgtggcaaaccaaaatcgccgagaagggggagcatcccgagaggggtacaatcagcgggggagaccttcatccaccggagggagtccacaggggagatctgcaagattacagatttgaggccccgcga

SEQ ID NO: 430084 - DNA, 3827 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaatagagagattaaggatagagagattaaggatagagagattaaggatagagagattaaggatagagagatgggta

SEQ ID NO: 430085 - DNA, 3866 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430086 - DNA, 2323 bp, Homo sapiens
cattgtgcttttcccgtatgatgctgggcggttgtgtctcggctgtgtgtgcagggtcctcttgtacctctcgttatctcttccacctttcctttcgcagccctaagtaacggacttctctctagtcacttctgatagcggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430087 - DNA, 3693 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgtctggggtttggttagaattttatgcccacataaaccaaacttgtggctatgctatttgggccctgcataacatttgacataatacaaaatataaagtcatagggaaaagtcgacg

SEQ ID NO: 430088 - DNA, 2197 bp, Homo sapiens
cgggcgagacaaataattgactgaggtgccgaggactcgtgtttttaatttcagaggatcgatggatggcccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430089 - DNA, 4196 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacgaaatgcacacttagaagacacatgcgagaatgttgatagagcattatttgtaatagtgaaaaactggaaactatccaaatatccaccaggagtaaaatggagaagtaaattgtggtatagtcattcagtggaatcgtctacagctgtgttacccaaagtgtgctgcatagatcagctgcatctgcaacacctgagaatttaccagaaatgcggaagtttaggccccaactcggatattacacagaatcagaatctacagtttaacaggatctccaggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430090 - DNA, 3775 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430091 - DNA, 3866 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430092 - DNA, 2273 bp, Homo sapiens
gaagcccccggaagcctccccagaagctgttgccggtgctatgcgacctgtacagcctgcagaaccaaagatccatggtccaatataacatatcttcttcaagtatttatggggtaacatcccaaaataacacttttagatgtctctaggcaagagaaaaccttcgaacttttatttggctaattttttaggaaaggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430093 - DNA, 4499 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgagtaagtattttggtttttagatttgtatttttcttgaaattctcactaaatttcccaagtcttccaagtggaaattctaacaaaacaaatacttagccatattgcactatgaatgaagaggttctagttgaaattagtgttgggaccttttaagtgatttaaatataaaggtagtgggccaggtgtggtggctcacgcctgtgatcccagcactttgggaggccaagttgggtggatcatttgaggtcaggagttcaagaccagcctggccaacatggtgaaaccccctctctactaaaaatgcaaaaattagttgggcggtagtggtgcgtccctgtaattccagccacttgggaggctgaggcagaagaatcacttgagcctgggaggtggaagttgtggggagccgagattgcaccactgcactccagtctgggcgacagagtgagaccctgtctcaaaaaaacaaaaaaacaaaaaagaagatagcggattgaaatcgcttcaaaaaaaattataaattgaacaccatgaatgaaaactaaagccctttcctaatactcatttcctttcttccagttacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430094 - DNA, 3862 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430095 - DNA, 3785 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430096 - DNA, 3340 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagcctctctttgacaagagaaattggctggagacatgaaaagtatagtagtcgtcacagaaaaagtagcgacagcaggca

SEQ ID NO: 430097 - DNA, 3277 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatatttactggcacagcgctcttcattctctccattttcattacaaaagcaggccttacaatattgattgtc

SEQ ID NO: 430098 - DNA, 1797 bp, Homo sapiens
caggagaggcggggtgaatcggacgaggcaggtccttcactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430099 - DNA, 1589 bp, Homo sapiens
  misc_feature (6)..(6): n is a, c, g, or t
gctganctagaggatcccgaacgggtgatgggttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430100 - DNA, 3037 bp, Homo sapiens
  misc_feature (2999)..(2999): n is a, c, g, or t
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttattncccgcagatgacgccgatgtagctcattgggttccgat

SEQ ID NO: 430101 - DNA, 3040 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatttatttcccgcacatatgagccacgtcggagggatcctgctagagcgcc

SEQ ID NO: 430102 - DNA, 2962 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagctttacctgatcagacctgtttccgggttatagctgtctcctggatcatagctgttgtccggatcatagctgtttccgggt

SEQ ID NO: 430103 - DNA, 3090 bp, Homo sapiens
  misc_feature (3059)..(3059): n is a, c, g, or t
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcggggcaagcctgagaagggaaatcagaaaaccccccaggcctttggagggcccctttcctttgggaaaaaccaaaaaactctggaaaaaccaaaagggggggaaaaaccaaactttttgggggggtattaaaaagggccccaaattttcccaaagggggttttgtggaccctcctgngttttaaaccccccaaataagcactttggga

SEQ ID NO: 430104 - DNA, 1383 bp, Homo sapiens
gagagggcttacacgaggaggcgccatttaactggatcttatatgatggctgaagtaggaaaaacatttaagcagaaacagtacaagcagaggtccaaggaaaagcacggagacgtggcacattgagaaccacaagtagtttgggatggctgatgtgagcaagactgcggcatcttgctcccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430105 - DNA, 3018 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcaggtgaggtttgaagaccagcagatgttggtagaattttgtaagatataatttgctttgtgttttatcccaaattcctaattttgtatgctgtattagtgaacagaccttggtttacatatgggggaaaaaaatctttgtacctcctcctgctccggcagcattgtgtcaacgcggacagattcaactcggagccagccttggacttgtgtccatcacctgtagaatgaac

SEQ ID NO: 430106 - DNA, 3857 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaagtaagtagcttttaaaatgaaaaaaattactatgttcttgtgaagaaagttgtgtattctaaatattgattttggtgtggacactgatgcatatgatttctgtatgggaagttagtatttattgtgactaaggactaattacagttgctgtgctttgttttaaaagcatcttttttgttgtcagttgttgattattttaatattgaaatatgcattatgggtgagctctaaatagtaagtattctgtatttatagagtttgggttgtgcctgtctcccaaattttcattgaaattgaactgtacttgcaggccacctacacgggtggggttttgagcagcatttctcaaatgtgaattatatataaagcatcattaatctggttctagtgcatgttctaatcagtaggtctgagaaggctctgcattttcttgaaacctcttaggtgatgtggatgctactgaaaaaaaaaatcacaaggaaaaaaagatcgtttccctttatcaccatatgaattaattcttctgccatttgacactgttactatctgcaacagttcttgcagtagaggatgcacttcaaagtgcactgctttactgtctcactggaattctaaaaatctaagctttatctttttaacattaagctgtgtgggaatgtagcaacctcctgggtggtggggtggggggcatcttcagttatttaggtctcactggaaagtttgagatcagagtttggtaggtggtgtaaggggacaatgagtaagggagagaaaatacaggactgacttggggcaaaaaacgcctgataataatttgtgaagcacattttcaaactcatttattccttacaaggatcctaagaggcgggtattatgtccaggttatacctggaggcttaaatgaagaaacatctacaagggcacacagtttaatgaatggctgaggtagaattggaattaaggtgttccgcacccacagccctcagtcgttatacacctgaggatgtaaattcctgtgctgggtgatgttagatttgtgtgttttatctactaaaatgttatttatttatttatttatttgagacatcaaatcgttttgctctgtcgccgaggctggagtgcagtggcgtgatctcagctcacttcaccctccaccttccaggttcaagtgattctcctacctcagcctcccgagtagctggaattacagatgcatgccaccatgcctggctaatttatg

SEQ ID NO: 430107 - DNA, 3089 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggtaagagcctgtgtttaaaacctcagtgatccaaaacctcatcttcaacataatgtgtatatgagatatagtttaaataatgagatgagatcagtctatgagtaataagatgctttttatttttattgaaataaaattaacatataatgatatgcatggatcttcagttaaaaaaaatccagttttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccaga

SEQ ID NO: 430108 - DNA, 935 bp, Homo sapiens
cagaatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430109 - DNA, 945 bp, Homo sapiens
tgcttgcactcattctctctcctgctgacctatgaggggtgctttccaccgtgattataagtttccagaggtctccccagccatgtggaactgtgagttaactaaacttcttttctttataaattactcagtctcagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430110 - DNA, 744 bp, Homo sapiens
cgggtgggcctcacaacagctagcacatggtaggccccatagcctgtaagaagccggctacatagacagaatgcgctattatccaagtagtttctgggaataggcccttaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 430111 - DNA, 2541 bp, Homo sapiens
  misc_feature (2401)..(2401): n is a, c, g, or t
  misc_feature (2428)..(2428): n is a, c, g, or t
  misc_feature (2460)..(2460): n is a, c, g, or t
  misc_feature (2465)..(2465): n is a, c, g, or t
  misc_feature (2469)..(2469): n is a, c, g, or t
  misc_feature (2473)..(2474): n is a, c, g, or t
  misc_feature (2478)..(2478): n is a, c, g, or t
  misc_feature (2481)..(2481): n is a, c, g, or t
  misc_feature (2484)..(2484): n is a, c, g, or t
  misc_feature (2489)..(2489): n is a, c, g, or t
  misc_feature (2499)..(2499): n is a, c, g, or t
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattctttagatcaccgngtttgaaacccttatagaattaacttncggtgaatcttgggcagaattggaaagcctanctttncccncttnngctnggnacngcccnggttgccgcnagtgtatggcggccatgcgggaaccgggactgtcctctggcg

SEQ ID NO: 430112 - DNA, 3668 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgagtaagtattttggtttttagatttgtatttttcttgaaattctcactaaatttcccaagtcttccaagtggaaattctaacaaaacaaatacttagccatattgcactatgaatgaagaggttctagttgaaattagtgttgggaccttttaagtgatttaaatataaaggtagtgggccaggtgtggtggctcacgcctgtgatcccagcactttgggaggccaagttgggtggatcatttgaggtcaggagttcaagaccagcctggccaacatggtgaaaccccctctctactaaaaatgcaaaaattagttgggcggtagtggtgcgtccctgtaattccagccacttgggaggctgaggcagaagaatcacttgagcctgggaggtggaagttgtggggagccgagattgcaccactgcactccagtctgggcgacagagtgagaccctgtctcaaaaaaacaaaaaaacaaaaaagaagatagcggattgaaatcgcttcaaaaaaaattataaattgaacaccatgaatgaaaactaaagccctttcctaatactcatttcctttcttccagttacttagatcaaccgtgttatgaaaccattaatagaattaaactttacagtgaatctttggcaagatatggcaaaagcccatacctttatccactctatggccttggagaactgccccaaggatttgcaaggtaagagcctgtgtttaaaacctcagtgatccaaaacctcatcttcaacataatgtgtatatgagatatagtttaaataatgagatgagatcagtctatgagtaataagatgctttttatttttattgaaataaaattaacatataatgatatgcatggatcttcagttaaaaaaaatccagttttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccaga

SEQ ID NO: 430113 - DNA, 2550 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaacggttatgaaccttatagattaacttaacgggaacctgggcaaatgggaaagccaaactatcacctaggctggagaatgcccagatgacgcagcgacaaggcgccaagcggacctggaattgtcacaggaaacgtaaaaaacaaacgtacaa

SEQ ID NO: 430114 - DNA, 2724 bp, Homo sapiens
  misc_feature (2397)..(2397): n is a, c, g, or t
  misc_feature (2627)..(2627): n is a, c, g, or t
  misc_feature (2649)..(2649): n is a, c, g, or t
  misc_feature (2651)..(2651): n is a, c, g, or t
  misc_feature (2657)..(2657): n is a, c, g, or t
  misc_feature (2675)..(2675): n is a, c, g, or t
  misc_feature (2701)..(2701): n is a, c, g, or t
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctctcgcccagccccactgccgcgggctgggaaatgngacaattggggcccctgcggaggggcacagccctctcaaagctgtcaccagggccaaagtgctgggtggagcagatgcaccgatggacttggcacacccagctcagcctcaagcatcctcttgagaagcctgtggaaggctcctgcgttcgttaactgccatctggccgtctctcagttttgaaatctctgaggagcctgaggatcaagtcagtttggggaaccgaattngtccatgggaagctgaggaatntnggacanatccggccctttgaaagnaccagttatgttccatttttggtggnttttcccaggatgcgtgaacttt

SEQ ID NO: 430115 - DNA, 2560 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgacaactgtgacgcagaaactgatagatttactatgagaatgcaagcgcggtgcttcactgaaagcccagttaaaataaggaaatttagagacccttttgaacaggttggaaactccttttgggacacaagcacttacttgggcctacacacaaaggaccccccaagtttaaacccccttatttttaaaattccc

SEQ ID NO: 430116 - DNA, 2251 bp, Homo sapiens
tggcaattgtgaaaaaagctctttattgttattgctaataaaaaaaaaagggccaatagtcaggtgtggtggcctgtacctcttgtccctgctactggggagactgaggtgggaggatggcttgagcccaggagatcaaggctgcagtgaggcatgattacaccgctgcactccagcctggacgacagggtgagattgtctcagaaaaataaagaaaaagggttatttcatattggttcaaaaatataggtagtatgaccccctgatgacttgaagacagagcaacagaaggaccttctttagtcatcattagcttagccaaaagaaaagtcagttacactcactgttgcataatcagttgtatggtcaactgtgcactaattcatttggtcacaaatatatacaatcaaattaaggttgaatgtaaatttaaactttacttttgctttcttctcccctcccccccagaaagatccatggtccaatataacatatcttcttcaagtatttatggggtaagaaacattttaaaaagttgttacattctttcctctatcttaatgatttaaatatgagcaagttcggtctatcaaggcaggctctgaatagctactatcgagaagtatttgaggagttcttgaatgccaaatcttcattgtctgctgactctgcagatttatcacgtgctgaaagcacaggttttccaactgtcaacgtctttacgaaattcacctgcttaggctttcgtggggtcggcctcttggagctgagaacacagcttctgcttacacctgtgtcctcaatgaagctagagattcctaagagaattctagaaaaagaggagcggggtagaaggcaagcaaggaacagtttctaagcttagggcctaaacctttgcatacaaggatcagctaccacgtttacagcggctttaagttacagccctcggtaggtgcagatcggcttcccaatgaaacctggctttcactgttcatctctgttaagggttaccttttcaaaagaagccgcttttcctcctaccaatttcctaaagcgcccaccggcaacgcactaaacaaggagggcacagagcgggaaaaaggacacgtgtgatttccgaactcttcccggcgggctccgggccccggcaagcccagccccgcgggaggaaccaaggccgccacccccgagaggcagcccggcccgcgctcctcgcccacgtggccgccgcacgcgcccgctcaaagtccaagggcggcgatccggctctgggaccttggaccgagcgagctcccgccccgacggcgggagtcagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctacctaatgggattgtttgaaaaacgtcgcttcacactacacgtcgccttggacctagtttgatcct

SEQ ID NO: 430117 - DNA, 518 bp, Homo sapiens
cattgctatagttagtacaactgtggaaaccaaggagcctgagaaggaaatcagaccagctttggagctcttggaaccaattgaacagaagtgagttgtgttcttttatatctgccgagatgcaaactgaggcctttgattgtggctccatggtgggacgaatgtgagggcaaggcaggtagctgctggctgctctgtgggattcatctgtacctctcagttgacctcaggcagagccatggtcaggtgtgggaccagctcacctgactgaattctctctccctccagatttgttagcatcagtgacctcctggtaccaaaagacttgggaacagaaagccaggtgagtatggaagtgtgaaaggatatgggcaggtttcactggaagacatccctccatggtcttaagtcttcgtaatttttgttttcagaatctttatttcccgcacatatgatgccaccactcattttgagacaacgtgtgatgacattaaaaacatctataagaggatgacagg

SEQ ID NO: 430118 - DNA, 510 bp, Homo sapiens
gacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctgg

SEQ ID NO: 430119 - DNA, 454 bp, Homo sapiens
tactaatttcgcggccgcgtcgacggggaagggtgggtagagggtcctcttctcatccctgactaggctcctgggcatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430120 - DNA, 1546 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430121 - DNA, 2372 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtagggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaactagaaaaagtagggaggaaagaggaaaagaggaggcgtctacactgagggggttctagagagggaggggtggactccgtagatgggggtagttcagtctcgaaacctggggcgtgctctgtcctggaggagggaggcgggcagtcggaggggaattgaatggaagttctgtgttggaaatgttttgggagatcttctgtagggggactgtggaagggggtctacattggggtaagtgcaggaggtagaggcttacacgtgaatcgattctgcactgaaataactagggaaagaggatgctaccctgaaagtggggatacttactttcgatgatgtgggggagggaggaggtctatactggcggaattgagggagtggagggtctgcactgaagacgctggggaaggatgtgccatggatatgggaaggaaccctagctgattagagagcctctcgggaggatgggaggatgggaagaggaggtttcctgtttgtacccccgaaaatatgggtgaaggacctgtgccgtggcccgtgagaaggaggtctgggtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430122 - DNA, 2207 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtagggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaactagaaaaagtagggaggaaagaggaaaagaggaggcgtctacactgagggggttctagagagggaggggtggactccgtagatgggggtagttcagtctcgaaacctggggcgtgctctgtcctggaggagggaggcgggcagtcggaggggaattgaatggaagttctgtgttggaaatgttttgggagatcttctgtagggggactgtggaagggggtctacattggggtaagtgcaggaggtagaggcttacacgtgaatcgattctgcactgaaataactagggaaagaggatgggaggatgggaagaggaggtttcctgtttgtacccccgaaaatatgggtgaaggacctgtgccgtggcccgtgagaaggaggtctgggtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430123 - DNA, 2085 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggtgagtgagacaggggcttcgacctggccagtacaaagcagcctgcacagtggttaacaactcaggattggccgggcacggtggctcacgcctgtagtcccagcactttgggaggctgaggtgggcagatgacaagttcaggagttcgagaccagcctggtcaacatagtgaaaccccatctctactaaagatacaaaaaaatagtcgggcgtggtggcacgtgcctgtaatcccagctactcgggaggctgaggcaggagaattgcttgaacccaggaggcggagattgcagtgagctgagatcgcaccactgcactctagcctggtgacagagtaagactccatctcgaacaacaaaaaaaaaagaactcatgattaggactgaattcagacgctggctgcccttggcccgctgtataaccgaggcaaaggactttgccctgagcccgtggaatccaaggatggtctcctctctctacctgcctgccagcgctgggatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430124 - DNA, 1735 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtagggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430125 - DNA, 1760 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtagggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaactagaaaaagccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430126 - DNA, 1763 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagcctggtgacagagtaagactccatctcgaacaacaaaaaaaaaagaactcatgattaggactgaattcagacgctggctgcccttggcccgctgtataaccgaggcaaaggactttgccctgagcccgtggaatccaaggatggtctcctctctctacctgcctgccagcgctgggatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430127 - DNA, 1280 bp, Homo sapiens
gcggggctagccggatccgctgactgatggtggggcgcaagagggttggagctgcagggttacgggaataaaaccgggaaagccggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430128 - DNA, 1501 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggtgcgtgcgacgacctgggacgctggaaacccggagctgcgcgctgggcggaaaggactcctagtgggcccggctgagaaggcggaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430129 - DNA, 1242 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430130 - DNA, 1363 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggtgcgtgcgacgacctgggacgctggaaacccggagctgcgcgctgggcggaaaggactcctagtgggcccggctgagaaggcggaggtggcgcgcgaggggcgggctcgtgccaacgctggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430131 - DNA, 1471 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430132 - DNA, 1437 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggtgagtgagacaggggcttcgacctggccagtacaaagcagcctgcacagtggttaacaactcaggattacaggcatgagccaccttacccagcctaattccttttttaattgagatatttacatactataaaattcacccttgtatatgattcgtggcttttactatattcccaaggttgtgcagccatcaccactatctatttcctagaacattttcatcacccca

SEQ ID NO: 430133 - DNA, 616 bp, Homo sapiens
ctcaagttttagctgccattgtgaggccatggctgtggctcccaggagtcaagatcacagactgctcagccctgacgtgtgtgtgtgtgtgtgtttgtgtgtgtgtgtaaaactacaactcccagcagccctaggcctatggttcagttacagcagggggtgtgtgtgtgtgtgtgtgtgtgtgtgtgtgtgtgtgtgtgtgtaaaactacaactcccagcagccctaggcctatggttcatcctaggttacagcaggggctgcagggagttgtagtcctccaagccctgactcctaccttggtggacagtggctgggtgttttccctgactcctgtccccacttcccctgcaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430134 - DNA, 433 bp, Homo sapiens
gactttgccctgagcccgtggaatccaaggatggtctcctctctctacctgcctgccagcgctggggtgagacacaggcccagtacacagagcctgctcagggaattagctgccactgtcatcatcatcgtaactaatgatggtgaacagaccaatagcaggaaagctacatcccttagggtttcgctgtgcagtggcactttctgccatgatggaaatgacagtcacctgcactgtccggtgcagcagccactagccacaggggccaagcactcaggtgaggcgagtgcaaccaggacgtgattcgttttaattggttacaatttaaactgaaataaccttacatgactaatggctgcaattggacaatgcagcctcagacaggactgaatgccaaccagcttctccagattcactgagcatccttgggagc

SEQ ID NO: 430135 - DNA, 1587 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430136 - DNA, 1535 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggtgcgtgcgacgacctgggacgctggaaacccggagctgcgcgctgggcggaaaggactcctagtgggcccggctgagaaggcggaggtggcgcgcgaggggcgggctcgtgccaacgctggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430137 - DNA, 1414 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430138 - DNA, 2056 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggtgagtgagacaggggcttcgacctggccagtacaaagcagcctgcacagtggttaacaactcaggattggccgggcacggtggctcacgcctgtagtcccagcactttgggaggctgaggtgggcagatgacaagttcaggagttcgagaccagcctggtcaacatagtgaaaccccatctctactaaagatacaaaaaaatagtcgggcgtggtggcacgtgcctgtaatcccagctactcgggaggctgaggcaggagaattgcttgaacccaggaggcggagattgcagtgagctgagatcgcaccactgcactctagcctggtgacagagtaagactccatctcgaacaacaaaaaaaaaagaactcatgattaggactgaattcagacgctggctgcccttggcccgctgtataaccgaggcaaaggactttgccctgagcccgtggaatccaaggatggtctcctctctctacctgcctgccagcgctgggatctgattaccttcacggaaggaagcggacgctcaccacgctatgccctctggttctgtgtgggggagtcatggccccaggaccagccgtggaccaagaggctcgtgatggtcaaggtgcctgcagacctgagtccctggggctgaaaggggtggccttacagagggaagaggttgctcccaggaactccaactcccagagggccctctaaaaaactgcaacttccaagatctctgcaataaccagtttttcatccccgggagctccttcccatggcctcacctgcagaacctgttttgaactctctaaaccagtggcccccaaactatttggcaccagggaccagtct

SEQ ID NO: 430139 - DNA, 1206 bp, Homo sapiens
gggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 430140 - DNA, 3593 bp, Homo sapiens
agcggaggcgtagtctcggccccgggctgccgcgccagcccgtctccgcggcgggggaccgggctgccttggcccctcagcgctcgcgtcttttccggcagttggaacgcttcctgttgtcctcacccgtaaccgcctgttgccccctgtctcagagtccctcacgcgtcccctcccgtctttggctcgttggctgccgccgccggggcttcgccagccttcaagtcgagactactggccgaaggggcgtctgcggctctccgccgtccccagccctgcctctccctgggctctgcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcctgcctggaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaagggccatgtgaaactttctgactttggtctttgcacaggactgaaaaaagcacataggacagaattttataggaatctgaaccacagcctccccagtgatttcactttccagaacatgaattccaaaaggaaagcagaaacctggaaaagaaatagacgtcagctagccttctccacagtaggcactcctgactacattgctcctgaggtgttcatgcagaccgggtacaacaagctctgtgattggtggtcgcttggggtgatcatgtatgagatgctcatcggctacccacctttctgttctgagacccctcaagagacatataagaaggtgatgaactggaaagaaactttgacttttcctccagaagttcccatctctgagaaagccaaggatctaattttgaggttctgctgtgaatgggaacatagaattggagctcctggagttgaggaaataaaaagtaactctttttttgaaggcgttgactgggaacatatcagagagagacctgctgcaatatctattgaaatcaaaagcattgatgatacctcaaacttcgatgagtttccagaatctgatattcttaagccaacagtggccacaagtaatcatcctgagactgactacaagaacaaagactgggtcttcatcaattacacgtacaagcgctttgagggcctgactgcaaggggggcaataccttcctacatgaaagcagcaaaatagtactcttgccacggaatcctatgtggagcagagttctttgtataacatcatgcttttcctctcacactcttgaagagcttccaagaagttgatggaacccaccaatatgtcatagtaaagtctcctgaaatgtggtagtaagaggattttcttccataatgcatctgaaaaactgtaaacaaagacaaccatttctactacgtcggccataaacagctatcctgctttggaagagaagcatcatgagccaatttgataggtgttttaaaaataacttgagttttcctaagttcatcagaatgaaggggaaaaacagccatcatccaacattattgagattgtcgtgtatagtcatcgaatatcagccagttcctgtaattttgtgacacgctctctgccaagcccaccaagtatttcctttatagctaaaagttccatagtactaaggaaataaagcaataaagacagtctcagcagccaggattctggctgaaggaaatgatccgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatgttttgtcttctctcttggtatttcttctctcccaactttagccattttgccttggaatcatgattacaattttttcctttgcagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagta

SEQ ID NO: 430141 - DNA, 670 bp, Homo sapiens
  misc_feature (103)..(103): n is a, c, g, or t
  misc_feature (105)..(105): n is a, c, g, or t
gccttattttggcagatagggaagacatatctgaaaattggtactcactcgtatgttgtgtgtgtgtgtgtgtgtgtgtgtgtgtgtggtggctttgtatctncntgtttccaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaaggtattgggggggcattggcatgaactatgcacgtttactgatctgagcagcctctgctttaacacctgcacccctgtggtcatcccagtgggcgagctgtgacctgccttgtcatgattttccttttttttttaaacaggtaagtttgctgtcacttcctttctctgaaaggctatggttctgtaatttggttgaacatttctcttaaaaataaaggaaacttgaaaataagagcaaaattgatgtagagggcaattttgtaataaagccaaagatagtcaccttctcttagcatataattaactgtgttactaatacatcacctatctagagcccttctgttgggcaacctcatcagttaatgaggaacccagccaagaagcaggaaatgcagtaacaac

SEQ ID NO: 430142 - DNA, 547 bp, Homo sapiens
ctttgggaaatcgagcttgccattaagctactgggcagtcctgcttatttagcttgggggtagcttctgatgttactcatagcctttggtttctagaacagaactctgggcacctcctgcctggctgggcctcgctgatgtgtggtccatgtttcaggccttctccacagtaggcactcctgactacattgctcctgaggtgttcatgcagaccgggtacaacaagctctgtgattggtggtcgcttggggtgatcatgtatgagatgctcatcggtaagttgcatggtttcagaggactttttctgtgcatccatgacagacttttacattgataccagcctctgtttcaattggcagtgatctaagtgatttccctacttgtctttcaaagtgaattgttttagacagatgacacctctttcagtaagatgtatcccactccattcttgggcttactggcatcctgcaattgctttgctgatcattttttatgtttttctttctcttataccttcatcttctccatctagaagctcttttagtca

SEQ ID NO: 430143 - DNA, 3888 bp, Homo sapiens
gaattccgggccaggcatggtagcgcatcgctgtaatcccagctactcgggaaactgaggtgggagaatcgattgaacctggaagtggaggttgcggtgagccaagatcatcctgtcgcactccagcctgggcaacaagagcgaaactccatctcaaaaagaaaaaaaaagatatatatgtgtgacttacaggtacaggtaaagttgcttctggttttctggttgttgcatggtatttcctatgcagccacaggtctttattttcttacttaagtgcctccaacttcccataacacaaattaaggcatgatgaacatcctctctgtgctgaacatcctgtgtatgtcacttcagaagcctgtgtgacggtttctttagtctttatacctaggggtgggatttctgggtcataggacagtaatttatatttatttcactaagtattctctttctctggcttttgttacatattacctgtttgtcctccagaaaacttgcaccaatttacattcctaccaatagggtaggagagtgcacaatgggtggattctaactccaaatctaacacctcttcttttctttgtttctagcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcctgcctggaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaagggccatgtgaaactttctgactttggtctttgcacaggactgaaaaaagcacataggacagaattttataggaatctgaaccacagcctccccagtgatttcactttccagaacatgaattccaaaaggaaagcagaaacctggaaaagaaatagacgtcagctagccttctccacagtaggcactcctgactacattgctcctgaggtgttcatgcagaccgggtacaacaagctctgtgattggtggtcgcttggggtgatcatgtatgagatgctcatcggctacccacctttctgttctgagacccctcaagagacatataagaaggtgatgaactggaaagaaactttgacttttcctccagaagttcccatctctgagaaagccaaggatctaattttgaggttctgctgtgaatgggaacatagaattggagctcctggagttgaggaaataaaaagtaactctttttttgaaggcgttgactgggaacatatcagagagagacctgctgcaatatctattgaaatcaaaagcattgatgatacctcaaacttcgatgagtttccagaatctgatattcttaagccaacagtggccacaagtaatcatcctgagactgactacaagaacaaagactgggtcttcatcaattacacgtacaagcgctttgagggcctgactgcaaggggggcaataccttcctacatgaaagcagcaaaatagtactcttgccacggaatcctatgtggagcagagttctttgtataacatcatgcttttcctctcacactcttgaagagcttccaagaagttgatggaacccaccaatatgtcatagtaaagtctcctgaaatgtggtagtaagaggattttcttccataatgcatctgaaaaactgtaaacaaagacaaccatttctactacgtcggccataaacagctatcctgctttggaagagaagcatcatgagccaatttgataggtgttttaaaaataacttgagttttcctaagttcatcagaatgaaggggaaaaacagccatcatccaacattattgagattgtcgtgtatagtcatcgaatatcagccagttcctgtaattttgtgacacgctctctgccaagcccaccaagtatttcctttatagctaaaagttccatagtactaaggaaataaagcaataaagacagtctcagcagccaggattctggctgaaggaaatgatccgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatgttttgtcttctctcttggtatttcttctctcccaactttagccattttgccttggaatcatgattacaattttttcctttgcagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagta

SEQ ID NO: 430144 - DNA, 3668 bp, Homo sapiens
agcggaggcgtagtctcggccccgggctgccgcgccagcccgtctccgcggcgggggaccgggctgccttggcccctcagcgctcgcgtcttttccggcagttggaacgcttcctgttgtcctcacccgtaaccgcctgttgccccctgtctcagagtccctcacgcgtcccctcccgtctttggctcgttggctgccgccgccggggcttcgccagccttcaagtcgagactactggccgaaggggcgtctgcggctctccgccgtccccagccctgcctctccctgggctctgcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcctgcctggaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaagggccatgtgaaactttctgactttggtctttgcacaggactgaaaaaagcacataggacagaattttataggaatctgaaccacagcctccccagtgatttcactttccagaacatgaattccaaaaggaaagcagaaacctggaaaagaaatagacgtcagctagccttctccacagtaggcactcctgactacattgctcctgaggtgttcatgcagaccgggtacaacaagctctgtgattggtggtcgcttggggtgatcatgtatgagatgctcatcggctacccacctttctgttctgagacccctcaagagacatataagaaggtgatgaactggaaagaaactttgacttttcctccagaagttcccatctctgagaaagccaaggatctaattttgaggttctgctgtgaatgggaacatagaattggagctcctggagttgaggaaataaaaagtaactctttttttgaaggcgttgactgggaacatatcagagagagacctgctgcaatatctattgaaatcaaaagcattgatgatacctcaaacttcgatgagtttccagaatctgatattcttaagccaacagtcctgtcttcagcaccgtgagcagtccattggaggcaaggcagtgaatcaactctcacatctatttctttcccagtggccacaagtaatcatcctgagactgactacaagaacaaagactgggtcttcatcaattacacgtacaagcgctttgagggcctgactgcaaggggggcaataccttcctacatgaaagcagcaaaatagtactcttgccacggaatcctatgtggagcagagttctttgtataacatcatgcttttcctctcacactcttgaagagcttccaagaagttgatggaacccaccaatatgtcatagtaaagtctcctgaaatgtggtagtaagaggattttcttccataatgcatctgaaaaactgtaaacaaagacaaccatttctactacgtcggccataaacagctatcctgctttggaagagaagcatcatgagccaatttgataggtgttttaaaaataacttgagttttcctaagttcatcagaatgaaggggaaaaacagccatcatccaacattattgagattgtcgtgtatagtcatcgaatatcagccagttcctgtaattttgtgacacgctctctgccaagcccaccaagtatttcctttatagctaaaagttccatagtactaaggaaataaagcaataaagacagtctcagcagccaggattctggctgaaggaaatgatccgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatgttttgtcttctctcttggtatttcttctctcccaactttagccattttgccttggaatcatgattacaattttttcctttgcagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagta

SEQ ID NO: 430145 - DNA, 1518 bp, Homo sapiens
  misc_feature (8)..(8): n is a, c, g, or t
agctgggncctctataggatcgcagcccaccaagtatttcctttatagctaaaagttccatagtactaaggaaataaagcaataaagacagtctcagcagccaggattctggctgaaggaaatgatccgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatgttttgtcttctctcttggtatttcttctctcccaactttagccattttgccttggaatcatgattacaattttttcctttgcagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagta

SEQ ID NO: 430146 - DNA, 3093 bp, Homo sapiens
gaattccgggccaggcatggtagcgcatcgctgtaatcccagctactcgggaaactgaggtgggagaatcgattgaacctggaagtggaggttgcggtgagccaagatcatcctgtcgcactccagcctgggcaacaagagcgaaactccatctcaaaaagaaaaaaaaagatatatatgtgtgacttacaggtacaggtaaagttgcttctggttttctggttgttgcatggtatttcctatgcagccacaggtctttattttcttacttaagtgcctccaacttcccataacacaaattaaggcatgatgaacatcctctctgtgctgaacatcctgtgtatgtcacttcagaagcctgtgtgacggtttctttagtctttatacctaggggtgggatttctgggtcataggacagtaatttatatttatttcactaagtattctctttctctggcttttgttacatattacctgtttgtcctccagaaaacttgcaccaatttacattcctaccaatagggtaggagagtgcacaatgggtggattctaactccaaatctaacacctcttcttttctttgtttctagcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcctgcctggaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaagggccatgtgaaactttctgactttggtctttgcacaggactgaaaaaagcacataggacagaattttataggaatctgaaccacagcctccccagtgatttcactttccagaacatgaattccaaaaggaaagcagaaacctggaaaagaaatagacgtcagctagccttctccacagtaggcactcctgactacattgctcctgaggtgttcatgcagaccgggtacaacaagctctgtgattggtggtcgcttggggtgatcatgtatgagatgctcatcggctacccacctttctgttctgagacccctcaagagacatataagaaggtgatgaactggaaagaaactttgacttttcctccagaagttcccatctctgagaaagccaaggatctaattttgaggttctgctgtgaatgggaacatagaattggagctcctggagttgaggaaataaaaagtaactctttttttgaaggcgttgactgggaacatatcagagagagacctgctgcaatatctattgaaatcaaaagcattgatgatacctcaaacttcgatgagtttccagaatctgatattcttaagccaacagtggccacaagtaatcatcctgagactgactacaagaacaaagactgggtcttcatcaattacacgtacaagcgctttgagggcctgactgcaaggggggcaataccttcctacatgaaagcagcaaaatagtactcttgccacggaatcctatgtggagcagagttctttgtataacatcatgcttttcctctcacactcttgaagagcttccaagaagttgatggaacccaccaatatgtcatagtaaagtctcctgaaatgtggtagtaagaggattttcttccataatgcatctgaaaaactgtaaacaaagacaaccatttctactacgtcggccataaacagctatcctgctttggaagagaagcatcatgagccaatttgataggtgttttaaaaataacttgagttttcctaagttcatcagaatgaaggggaaaaacagccatcatccaacattattgagattgtcgtgtatagtcatcgaatatcagccagttcctgtaattttgtgacacgctctctgccaagcccaccaagtatttcctttatagctaaaagttccatagtactaaggaaataaagcaataaagacagtctcagcagccaggattctggctgaaggaaatgatccgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatttaggtaaagatcctgtagagtcacctcagcacactcgt

SEQ ID NO: 430147 - DNA, 1444 bp, Homo sapiens
cattcctttatagctaagatactaataaagacagtctcagcagcagacgcgagcgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatgttttgtcttctctcttggtatttcttctctcccaactttagccattttgccttggaatcatgattacaattttttcctttgcagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagta

SEQ ID NO: 430148 - DNA, 2316 bp, Homo sapiens
agcggaggcgtagtctcggccccgggctgccgcgccagcccgtctccgcggcgggggaccgggctgccttggcccctcagcgctcgcgtcttttccggcagttggaacgcttcctgttgtcctcacccgtaaccgcctgttgccccctgtctcagagtccctcacgcgtcccctcccgtctttggctcgttggctgccgccgccggggcttcgccagccttcaagtcgagactactggccgaaggggcgtctgcggctctccgccgtccccagccctgcctctccctgggctctgcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcctgcctggaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaagggccatgtgaaactttctgactttggtctttgcacaggactgaaaaaagcacataggacagaattttataggaatctgaaccacagcctccccagtgatttcactttccagaacatgaattccaaaaggaaagcagaaacctggaaaagaaatagacgtcagctagccttctccacagtaggcactcctgactacattgctcctgaggtgttcatgcagaccgggtacaacaagctctgtgattggtggtcgcttggggtgatcatgtatgagatgctcatcggctacccacctttctgttctgagacccctcaagagacatataagaaggtgatgaactggaaagaaactttgacttttcctccagaagttcccatctctgagaaagccaaggatctaattttgaggttctgctgtgaatgggaacatagaattggagctcctggagttgaggaaataaaaagtaactctttttttgaaggcgttgactgggaacatatcagagagagacctgctgcaatatctattgaaatcaaaagcattgatgatacctcaaacttcgatgagtttccagaatctgatattcttaagccaacagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagta

SEQ ID NO: 430149 - DNA, 1524 bp, Homo sapiens
agcggaggcgtagtctcggccccgggctgccgcgccagcccgtctccgcggcgggggaccgggctgccttggcccctcagcgctcgcgtcttttccggcagttggaacgcttcctgttgtcctcacccgtaaccgcctgttgccccctgtctcagagtccctcacgcgtcccctcccgtctttggctcgttggctgccgccgccggggcttcgccagccttcaagtcgagactactggccgaaggggcgtctgcggctctccgccgtccccagccctgcctctccctgggctctgcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcctgcctggaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaagggccatgtgaaactttctgactttggtctttgcacaggactgaaaaaagcacataggacagaattttataggaatctgaaccacagcctccccagtgatttcactttccagaacatgaattccaaaaggaaagcagaaacctggaaaagaaatagacgtcagctagccttctccacagtaggcactcctgactacattgctcctgaggtgttcatgcagaccgggtacaacaagctctgtgattggtggtcgcttggggtgatcatgtatgagatgctcatcggtaagttgcatggtttcagaggactttttctgtgcatccatgacagacttttacattgataccagcctctgtttcaattggcagtgatctaagtgatttccctacttgtctttcaaagtgaattgttttagacagatgacacctctttcagtaagatgtatcccactccattcttgggcttactggcatcctgcaattgctttgctgatcattttttatgtttttctttctcttataccttcatcttctccatctagaagctcttttagtca

SEQ ID NO: 430150 - DNA, 1370 bp, Homo sapiens
agcggaggcgtagtctcggccccgggctgccgcgccagcccgtctccgcggcgggggaccgggctgccttggcccctcagcgctcgcgtcttttccggcagttggaacgcttcctgttgtcctcacccgtaaccgcctgttgccccctgtctcagagtccctcacgcgtcccctcccgtctttggctcgttggctgccgccgccggggcttcgccagccttcaagtcgagactactggccgaaggggcgtctgcggctctccgccgtccccagccctgcctctccctgggctctgcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcctgcctggaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaaggtattgggggggcattggcatgaactatgcacgtttactgatctgagcagcctctgctttaacacctgcacccctgtggtcatcccagtgggcgagctgtgacctgccttgtcatgattttccttttttttttaaacaggtaagtttgctgtcacttcctttctctgaaaggctatggttctgtaatttggttgaacatttctcttaaaaataaaggaaacttgaaaataagagcaaaattgatgtagagggcaattttgtaataaagccaaagatagtcaccttctcttagcatataattaactgtgttactaatacatcacctatctagagcccttctgttgggcaacctcatcagttaatgaggaacccagccaagaagcaggaaatgcagtaacaac

SEQ ID NO: 430151 - DNA, 379 bp, Homo sapiens
tgacctagagttacttatcgccaacaccgcacttcttctatttacccaggcttaccacacattcttgcaaacacacggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagta

SEQ ID NO: 430152 - DNA, 110 bp, Homo sapiens
gctttcccaaatagaaactggtgtgttcttcatagtcctgtcttcagcaccgtgagcagtccattggaggcaaggcagtgaatcaactctcacatctatttctttcccag

SEQ ID NO: 430153 - DNA, 843 bp, Homo sapiens
aaattgtttaagcaaatatacaatctaataaagcagagcaagctttgtcattaatcaaatgcatatacctccaggttggccacattcgtgcggagcgtgacattctagtggaggcagacagtttgtgggttgtgaaaatgttctatagttttcaggataagctaaacctctacctaatcatggagttcctgcctggaggtaattacttgacgatgaaaggtcattttttctttttgttctgtggtttctttctctcacatcacgattaaccctcctttctacttttaaatgtgctcacaaagttgctttctatatccttttttaggtctataaaggaagtcagtaacctgtcttgtgctggggtgcctttctacaatcttagtaccataaaagtaacctgttaattcatttacatgatttcagatggacatttctttcttttcttcttctttttaaaatatataggaataaattagggtgctctgcctgctctcctgtcaatgggaatcatatatgatcaataacccaagtgacaacattgaagctataacatcctttgctccaaatttttgtttctttttgtataacatattaataaggagtgaattttttgttacccatattagtagccagaaaaaatttctcatttctgaaattttaagttttatgtaactcagcatgagcatctcctaagacagctccaaagtaaacccagaacagaacatgccatctgttctgaggaaagcagtctgtttgtcagtgagcagatgaactctgagcaaactctggtgggaaaaaaaaagagagagaacttttttcttttttgttcctataattgtggca

SEQ ID NO: 430154 - DNA, 740 bp, Homo sapiens
atttccctgcggtttgcccacactccctgtggcaggaggagttagagtttgccatcatgcggatagaagccctgaagctggccaggcagattgctttggcttcccgcagccaccaggatgccaaggtaccggtttgctgctgcgtgcgccacctcctgagaatgtcatgtgtgccgctggggtccagaagctgctttgctaaccatccgccaggcgggcatcatcggtgtccagcaaagagtcgtttccaaaaagctgaaagcgtcactcttgcataaatacacactgagcacatagctaagatccatttaagtcgataatgctaaaccgcgggatagtaatgctggttaaatgagagagaatgcagagaccaatgtatgggtcagtagggtaaagaaggctagcctaagatgacaaagttggatagaaaactggttagcaccaattcaacagagcaaaacaaaatcatgacctttgagggttttttttttctacagataccatttgcttctctattgagcaaacataatttgcaacttttctattttctgcaagttaacatctgactttgttgagacaaggccctaatcaataatacatagtaagtgaaaccaagacatttgataatattctagaccaggcttaagcaattctttctgtaaagtgcaaatgataagtatttccagccttgtgggccgtactgtctggcactgttccaataaaacttttatttgtctgaa

SEQ ID NO: 430155 - DNA, 3993 bp, Homo sapiens
  misc_feature (253)..(253): n is a, c, g, or t
  misc_feature (361)..(361): n is a, c, g, or t
ggaaagccctttgcacacatcggcctattgaagcactttgcttgattcagctattctcctctcaggacctgcctggatcatcccagcctgtagaatcctgggtttctgtggcagtttgttcttctggtatcacctgctatgctctgaatgtttgtatccctctcagccccgaaattcctgtgttgaaatcctaacccctaaggtgatggtatgaggaggtggggccttcgggaggtgattaggccataagggnggagcctttgtgaatgggattagtgcccttataaaaagaggccccacagcactgccttgcctcttctgccacgtgaagatgcagtgagaaggagctgtctgtgaactnggaaggggtcctcatgagacactgaacctgctggtgccttgatcttggacttcccagcctccagaactttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaataagtgtgcctcgaatttattttctgggaagggttgagtcttttctcacctttgtcaaataccagatttggcttcgtgctcttctctgtctgggctcatttctttgtccatagacttaaataatatttcctttgttatcgtggctgcatttgtaggatgaagctaatgag

SEQ ID NO: 430156 - DNA, 876 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgtgctcagggtgatgtcaccctctg

SEQ ID NO: 430157 - DNA, 651 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgaccaggcttcagtgcctgaccaggcttcagtgcctgacc

SEQ ID NO: 430158 - DNA, 261 bp, Homo sapiens
atcaggttaaggaatagtaatggctcatttctacctcacgcgaggctgcacaggcccgggtctgggaagccagggctctggtttttgttctgttagagacagtctgggagggctctggggcgtgggttcgtcccaaggaaaagctggggtttgagatgcccccactggtgaggctgagttgcatctgaggcctcggctggccccagagacccagtttggactttctgggctccatcatttggctcctggtctctcctgcca

SEQ ID NO: 430159 - DNA, 4178 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430160 - DNA, 3687 bp, Homo sapiens
gagcctttcggggagccacgccggccctgcgccgttgtcccgggaaactttgcgtcccagggccgcaccggaccgtggtgaccccacgcgccgcgccgccaccgggctcggaaaacccagcgcccccgggctctttggcagttgcgactccgaacgaaggcggctccgtgcgggccatcccctatctccccgggcggttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccagtagagactgggtttcaccatgatgaccaggctggtctcaaactcctgacctcaagtgatctgcctgcctcggcctcccaaagtgctgggattacaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430161 - DNA, 4319 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430162 - DNA, 3962 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430163 - DNA, 781 bp, Homo sapiens
ttgcatatggcaaggccaagggcacaactccataggtagctttttctatttcgacgtggttcatcttccttcaagatatcctgcaccatgtccgctgccttacacaactccttggccttgccatatgcaagcatatggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430164 - DNA, 1567 bp, Homo sapiens
gaacttcccctccactgaggagagccacttcctcccagcactgacacaatgatgaatgacaccaggagttctaacctagaaacagagggcacgtggctctgggctggaacatgtctcaggagttctgaggttttcagggaagggctctgcacagcctcagggacaggcttttggtgaagactgatcttccatgggaatctcaaggaaaagctggctgcaaaacatccccagtatgctggagggatccagcccccttggagaaggccattggagatcggtcgtgctgttgaacttgatcagcatcagagccagcatgtaacctatctgaaagcaaagccacacgtccatgatggagggatcgtcccgctggatcccctcactttctgagaagatggacagtgtaggatcatctgtgctagacaaacctgtggttggttccccttgattagacaggcaaggtgtggtgggagaatcaccttaaagccagctcgcatctgccccccaccccccatgaccctgtagccacagcatcacctatttggcatccctctgagcaatgccagtgatcccattcacgtagaactgcgtaaccctccttatgctacatctcaaaaaagccacccgaggggtttacccaggacgctcctcacctcagatcacatccttcccgggcaaataaagggaaaggaaccagactagttagtccttcactctgtgctggtcactgccaggaaactacatttatcacctcatttacttctcagaaagaaacatgttatcacctatgttctagagataaggacaccaaggctcagagaggttgtgtaacttgtggaagatcacacagctacagctgggatatatactcagattgtttggctccaagtcatttgtctcactgctttagtggggaccaaggggcctggtggtcccccatctccccaaaaagccccatgagcattctgactggccagatttcaaacatcagcaacttcttccttgtcttcacttgcagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430165 - DNA, 626 bp, Homo sapiens
gcgtcgaccactcgcagctgctccttccgcaggctggcctggtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430166 - DNA, 3479 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaattaagaggttttgagagatgttcgcagagtacttccggtgaacgaatgtttgacttacttgagtgcaatatgacctcgg

SEQ ID NO: 430167 - DNA, 3818 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaaggtaccggtttgctgctgcgtgcgccacctcctgagaatgtcatgtgtgccgctggggtccagaagctgctttgctaaccatccgccaggcgggcatcatcggtgtccagcaaagagtcgtttccaaaaagctgaaagcgtcactcttgcataaatacacactgagcacatagctaagatccatttaagtcgataatgctaaaccgcgggatagtaatgctggttaaatgagagagaatgcagagaccaatgtatgggtcagtagggtaaagaaggctagcctaagatgacaaagttggatagaaaactggttagcaccaattcaacagagcaaaacaaaatcatgacctttgagggttttttttttctacagataccatttgcttctctattgagcaaacataatttgcaacttttctattttctgcaagttaacatctgactttgttgagacaaggccctaatcaataatacatagtaagtgaaaccaagacatttgataatattctagaccaggcttaagcaattctttctgtaaagtgcaaatgataagtatttccagccttgtgggccgtactgtctggcactgttccaataaaacttttatttgtctgaa

SEQ ID NO: 430168 - DNA, 268 bp, Homo sapiens
aagacatttaccgtttgtctgaaaatagccgaactgagccttttcttcaggctatatgagaagtctctagacagtgggcaccgtcagaaagcccagagccttgtgatagctcccaccctgcctggctcagatcttcccatttttttcctctggcactaacctcaccttttgtttttttgtgtttgtgtttgtttttgtttttgcagagttggattacagaaactcctatgaaattgaatatatggagaaaattggctcctccttacct

SEQ ID NO: 430169 - DNA, 254 bp, Homo sapiens
tccacatttattcaccgtctccttttcttgatctatgaattgctcagagctgaattcactcatttggggctaacctttctcttcttctctctgaaactagatcataaccaaggagagagaggtctcagaatggaaagataaatatgaagaaagcaggcgggaagtgatggaaatgaggtcagttggggagctgggccttcctcgtgcctgagggatacttacctgtggtttaataatgaccggagctggtgtgg

SEQ ID NO: 430170 - DNA, 783 bp, Homo sapiens
gggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggcggccgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgtaagtgctccgcccgggccgccccgagtctcccggggaggaggagaggatgcccgggctttgttagtgtcgcctttcctaatgcctgtgcaacctggagcccaggctggcctggggttcttcgcagccttggaaagctttacctggggctgctctgggaggagcatctggtagccccaagttactgctgtgggcagaaacgattccctggaattcagttttggtcgctcagcagtgggtgcatggctggggggcttctcctgccgtcagcatctttcctctgcacccccggcacagtggtatttcctgcaagggaacagccaggcatcagcgactgcctcctcctaggaagaacccatgagcgtggcagctccgtgcccggggc

SEQ ID NO: 430171 - DNA, 4069 bp, Homo sapiens
acaatgcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggcggccgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430172 - DNA, 3292 bp, Homo sapiens
  misc_feature (2)..(3): n is a, c, g, or t
  misc_feature (6)..(6): n is a, c, g, or t
  misc_feature (9)..(9): n is a, c, g, or t
cnnccnggnagggaaaggttttgtctatttctgttccttgttgaatctctagtacctagaaccatgtctggtcctgattaggcacttggtgaatgtttttgaatgaatactctgagctgttctttaatcggtcctcatgatcctcattgtacagatgagggaactctgggcgaacctggcctgggtcttgagctaattacgggtaggtcaggttctgtacccaagtagtacacacagtgatgggcggggtggcctggggccgtggtttgtcaacccctacgctggagggtgatgttttggtacaagaggagaggtgccccaatgcgtcctgtgtctgtaattgatggcgttgtctgtgtttccccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctg

SEQ ID NO: 430173 - DNA, 308 bp, Homo sapiens
  misc_feature (273)..(273): n is a, c, g, or t
ctgctgcctcctctcttcctggtggctccagaacaatgaaggcttttccctgatgggttatttgttctctgttgaagagtgctccagttttcatctccgttgcacgttcaggccaactgtacccaagctgatatgtgattttgatccctgcagcaggacgacgatgccccgaagaagcaggccttgtaccttatgtttgacacttctcaggagagccctgtcaagtcatctcccgtccgcatgtcagagtccccgacgccgtgttcagggtcnagttttgaagagggagcagccggcgatcctctaga

SEQ ID NO: 430174 - DNA, 3582 bp, Homo sapiens
ttttcaataggacatgaggagaaatgccttactatctacattatcctattaattgctttcttttattatcccagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430175 - DNA, 3341 bp, Homo sapiens
catctgccccagctggtgacagagtagaagcttccactccctcctgcccagatccggccaaggacctcagcaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 430176 - DNA, 3858 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagact

SEQ ID NO: 430177 - DNA, 3939 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggccaagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagacttccaattctgctatggttggatatctactaatctacaggtgaccagaaaccgctcagggtcgacctacgcctgcgtgcccg

SEQ ID NO: 430178 - DNA, 3599 bp, Homo sapiens
aaagcagcaccaggaaacatctgcctgcggcagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactactggcatcttggaaatgcggaaatgccctgggcaaccagagcacccctgcaccaccaactggagaagtggcagacactcccctggagcctggcaaggtggcaggcgctgctgggaaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccaggacctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgataggtaggtgtcctgacctgcgggggctcaggccggccccgatgtttctgaactatgaggaggccttggaagataggaggctcagagtgggtttctggtagagcgtgaagcctttcagggaaggaccagagcattccagaaaatatggctttgccccaggacagagtctggggcttcttggtaacacccccctgaactgtgccatagcattattcacacccatggaaagccatggcagtcacctgccagccaccatctgactcagccaaggactctctactttgtggggaaagagattccttttgggtgggatatttgggggattttttcttttcgcttgtgggagataataggaatcaaatccc

SEQ ID NO: 430179 - DNA, 487 bp, Homo sapiens
aaataaaataccttaggaacattttcctgaaagagtccacataaaattcattttaatgcatgtgtttatgcatagctttctatttttcctcttttcctctttaacattcccaaattaggaatataatgcctaatccaagtatagtggctgcgtttcctttccttccctcctagtctgcaggtagcatacaaatgtaataaagtactcattcatgtcacatctatttattttctgccttataccaagcttgtgggattctcttaaatacaacatttttatacttacacctatgcaatacccattagcatcgccttcctaaatcaggggaaattgagtctctgtaaggtgcagtaacttactaagatacaaaactcagcattaaagtctgtatacttcaatatcctgccctcttctcatttgtctttactgccttttatgtatgtgttagatgttcaataaattctcttttttaaactgaaaaaaaaac

SEQ ID NO: 430180 - DNA, 789 bp, Homo sapiens
  misc_feature (26)..(26): n is a, c, g, or t
  misc_feature (28)..(28): n is a, c, g, or t
acttacggctaggtcgaggctgggtntngcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggatgtgtggctcagggatgccagcactagctaagaatccagtcgaaacgtccag

SEQ ID NO: 430181 - DNA, 2891 bp, Homo sapiens
agtcacatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctccgagattgcaccacagcactccaacctgggtgacagagtgagtgagactctgtctaaaaaaaaaaagaaagaaagaagggagggagggaggaaggaaggaaggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatcttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctccctgtcagccagtattaacatgtccccttccccctgccccgccgtagattcaggacattcgcccctgtgtgccaccaaaccaggacttttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatgtaaaatatcttgagaataataaatgtgagggaataagaaaggcaagctttggacacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgcaa

SEQ ID NO: 430182 - DNA, 2839 bp, Homo sapiens
  misc_feature (26)..(26): n is a, c, g, or t
  misc_feature (28)..(28): n is a, c, g, or t
acttacggctaggtcgaggctgggtntngcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctccgagattgcaccacagcactccaacctgggtgacagagtgagtgagactctgtctaaaaaaaaaaagaaagaaagaagggagggagggaggaaggaaggaaggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatcttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctccctgtcagccagtattaacatgtccccttccccctgccccgccgtagattcaggacattcgcccctgtgtgccaccaaaccaggacttttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatgtaaaatatcttgagaataataaatgtgagggaataagaaaggcaagctttggacacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgcaa

SEQ ID NO: 430183 - DNA, 2184 bp, Homo sapiens
acacgagaggccgggtgtggtggcccatgcctgtagtgccagcattttgggaggctgaagcaggcgggtcacctgaggtcaagagttcaagactagcctggccaacatggcaaaaccccctctttactaaaaaatacaaaaattagccgggcgcggtggcgggtgcctgtaatcccagctactcaggaggctaaggcagggagaactgcttgaactcgggaggtgaaagttgcagtgagccgagattgcaccacagcactccaacctgggtgacagagtgagtgagactctgtctaaaaaaaaaaagaaagaaagaagggagggagggaggaaggaaggaaggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatcttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctccctgtcagccagtattaacatgtccccttccccctgccccgccgtagattcaggacattcgcccctgtgtgccaccaaaccaggacttttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatgtaaaatatcttgagaataataaatgtgagggaataagaaaggcaagctttggacacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgcaa

SEQ ID NO: 430184 - DNA, 1887 bp, Homo sapiens
agtcacatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggccgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagcacgtgttctgtgaggagtgcctctgcctgtggctggaccgtgagcgcacctgcccgctctgccgctcggtcgccgtggacaccctgcgctgctggaaggacggcgccacgtccgcacacttccaggtgtactaggaccgaacactgaggacacccagaaggacgccaagggtcagcatgcccggacccagccctgcgggggcttcctgagaaacaggcctcaagcacttacatcctgcctcttgccctccaccacctctgaccccaaagtcccgcccctgtcttgtccttctgaccttcatcttcctctctcgttctgtggtatagtgcgtgcctccttcccctgcaaaaggggacgtcttcctaactcagacttgatgcccttctagatgcatcttccttctccactccaagtcaaggacctggcaatacatgaagttcccacttgtt

SEQ ID NO: 430185 - DNA, 370 bp, Homo sapiens
agacggatcttcttgcgaagtttacttccctgagctcccttctacctttgtaacaccctccttcctgaggacacccagaaggacgccaagggtcagcatgcccggacccagccctgcgggggcttcctgagaaacaggcctcaagcacttacatcctgcctcttgccctccaccacctctgaccccaaagtcccgcccctgtcttgtccttctgaccttcatcttcctctctcgttctgtggtatagtgcgtgcctccttcccctgcaaaaggggacgtcttcctaactcagacttgatgcccttctagatgcatcttccttctccactccaagtcaaggacctggcaatacatgaagttcccacttgtt

SEQ ID NO: 430186 - DNA, 2203 bp, Homo sapiens
agtcacatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctccgagattgcaccacagcactccaacctgggtgacagagtgagtgagactctgtctaaaaaaaaaaagaaagaaagaagggagggagggaggaaggaaggaaggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatcttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctccctgtcagccagtattaacatgtccccttccccctgccccgccgtagattcaggacattcgcccctgtgtgccaccaaaccaggacttttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgca

SEQ ID NO: 430187 - DNA, 2502 bp, Homo sapiens
agtcacatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagctgtgaccaaggctggcccctctggggaactgggggccattgaacttgaagactgcagagccagcggtccttgggatcccgagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggccgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatgtaaaatatcttgagaataataaatgtgagggaataagaaaggcaagctttggacacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgcaa

SEQ ID NO: 430188 - DNA, 2447 bp, Homo sapiens
agtcacatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagctgtgaccaaggctggcccctctggggaactgggggccattgaacttgaagactgcagagccagcggtccttgggatcccgagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggccgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgcaa

SEQ ID NO: 430189 - DNA, 1263 bp, Homo sapiens
  misc_feature (1149)..(1149): n is a, c, g, or t
agtcacatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggccgtcaagtccaaggtaggcactggctgcggccacaaggtagcntaccagttttaaatgtcgtcagattttccattatgtattgattttgcaacttaggatgtttttgagtcccatggttcattttgattgtttaatctttgttattaaattcttgta

SEQ ID NO: 430190 - DNA, 4416 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactcttttcctttccaatatcctcatgacattcaatatttcacttactctaggtcctccctgcctaaggcccaagtcaactttctgtccagtgggatttgtaatccaatgcctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggataggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggtgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggct

SEQ ID NO: 430191 - DNA, 4305 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactcttttcctttccaatatcctcatgacattcaatatttcacttactctaggtcctccctgcctaaggcccaagtcaactttctgtccagtgggatttgtaatccaatgcctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccgggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggataggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggtgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggct

SEQ ID NO: 430192 - DNA, 2752 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (10)..(10): n is a, c, g, or t
tgantncntnggcctgctgggttagtgctggcagccccctgaggccaaggacagcagcatgacagtcaccaggactcaccacttcaaggaggggtccctcagagcacctgccatacccctgcacagtgctgcggctgagttggcttcaaaccatccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggataggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggtgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggct

SEQ ID NO: 430193 - DNA, 4362 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactcttttcctttccaatatcctcatgacattcaatatttcacttactctaggtcctccctgcctaaggcccaagtcaactttctgtccagtgggatttgtaatccaatgcctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggataggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggtgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacagggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggct

SEQ ID NO: 430194 - DNA, 2309 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactcttttcctttccaatatcctcatgacattcaatatttcacttactctaggtcctccctgcctaaggcccaagtcaactttctgtccagtgggatttgtaatccaatgcctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggtagagttacccatcagccttcacccacgtgccaccactgacccactgggtaacatctcagggcctcagcttgacctatcccccaggttcagagtgtgggctggtggcccacccaaaggccttgtaattagtctcaagggagccatttatatcccagaggaatccttcatcttcagtcttcctgttctacccaggaaaggtctccttccattaagatatcccttggtttctccatgtgctcttgaataaaatggaaaatgactcagtgaaaga

SEQ ID NO: 430195 - DNA, 2433 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactcttttcctttccaatatcctcatgacattcaatatttcacttactctaggtcctccctgcctaaggcccaagtcaactttctgtccagtgggatttgtaatccaatgcctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagggcacaaactgcagctgtgagtgcgtgtgtgtgatttggtgtaggtaggtctgtttgccacttgatggggcctgggtttgttccttgggcactgggtacccaagtgaaggttcccgaggacatgagtctgtaggagcaagggcacaaactgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggct

SEQ ID NO: 430196 - DNA, 1085 bp, Homo sapiens
gctcttaaaaattagttaaacatccaccctgtcagctaatttaccctatttatgtgctcaacaaactttttgaaaactaaagtctaccccactttttagttatacattcttatttaacagagtttaatatttattcagttgtgttcttatttaaagccattatacctaaaatacttacgttataagcatatctagtatttaagataataaaaatattaatgctgaatgtgtgatcttgcacttatttccctactgccacaactcagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggtgtccagccgtccttctgagttttgctagatgcgttaaaagaatgctttggaatgatttcaccagttgagggcactcatgtcagggcttgatttttaaattcccatctacttagttcgtaaaacatcattttcatgcagatactataatactgttttgcaagctattcttttagtattttatggtgaaaaattggtaattaaaattcttattttagtttattcatgcaaatctatagacatttgaagacatggtaatagaatgagagaaggagcaaagttatacttacatatatgttccttgatgtaaggataaggtaaattattgaaacttacattacaaaaattgaatttattttaattagaattgtacgtcaagttttttgggatatttttcagtctgtttctttttcctgttttactttttataccatcagaatatggatcatgtgtatcctgttagtagccacatagccttctcctagctcaatgcctagcacatagtaagcactcaatatttttttaattaatgaaattttttttaaaggagcagtccaaagatggtgacaagtcttttttcttttactttcaaggcagttttaggaagcattccctgtctatcttccaaatatgatctggattttaattttgcaaaaaaaaa

SEQ ID NO: 430197 - DNA, 1158 bp, Homo sapiens
  misc_feature (1017)..(1018): n is a, c, g, or t
  misc_feature (1036)..(1036): n is a, c, g, or t
  misc_feature (1038)..(1038): n is a, c, g, or t
  misc_feature (1041)..(1042): n is a, c, g, or t
  misc_feature (1061)..(1061): n is a, c, g, or t
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaagggtgacatttacgggtatgaaagttattccaatnnagataggacagtgttgananatnnggtcagcgggaagctttgncattggtggaacgctgttccatgagtaaagctacttgggtggagggcggaactgaataaacgtgaattgacaaacgggggggttaaaaaatggtgtg

SEQ ID NO: 430198 - DNA, 760 bp, Homo sapiens
tgggggcgactttgtggggagcctagctgctgctgggcgtttaccgcgggagcccttagcggtctggagctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggtattctcatcagtatcaggggaaatctaaatttccgattctaggatttcctgttttgtctataatataaattatttgaatcaaatacagcattcttttaagagtatcttttccaaatctagtatttatttattaaaatatatttaatctgattacaagtgtactcatctagcagaattcaactagtttttttgaatcttaatgaaagcaattaaaaatgaaaacctggccgggcgcaatggatcatgcctgtaatcccagcactttgggaggatgaggcaggtggatcacttgaggtcaggagttcaagatcagcctggccaacatggtgaaaccccatctctactgaaaaaatgcaaaaattagccagatgtggtagcgtgtgcctgttgtcccagctacttggaaggctgtggtagaagaatcaccttcgcctcccaggttcaagtgagccgagataatgccactgcactcctgggtgacagagcctgggtgacagagcgagactccatctcaaaa

SEQ ID NO: 430199 - DNA, 6359 bp, Homo sapiens
  misc_feature (2594)..(2594): n is a, c, g, or t
  misc_feature (3073)..(3073): n is a, c, g, or t
  misc_feature (3160)..(3160): n is a, c, g, or t
  misc_feature (5125)..(5125): n is a, c, g, or t
  misc_feature (5403)..(5403): n is a, c, g, or t
  misc_feature (5458)..(5458): n is a, c, g, or t
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagcttagattcccatgtagaattactgagtcaaagaatatgaacattttgattgttcttgatatgctttgctacatttcttctgaaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtgatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaanagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgntgtttgacatacctgagaaaaacaagaaatggggaaaggattccctatttaataaatggtgttgggaaaactggctagccatatgcngaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctgatgttttgttaaacctgataagttttgtactagtaaaattctagaattctaagcatagatttaaacattgctgaaaaatgagtttgtgtgttttatgccttccaggggacagttaagtgggcagtatttatttaatatacctgcttcagccccatttgaattgtaagcactctgaaagcatgtctcatagtcgtctgtatccctggtgtctcccacagtgccctgcttacctgcaggcctttttgtattttctgtccaagtaccctaatagggtggtgcagaatggatgtacagatctgtggatgacctcagcagcttaatccaaggcacccctcgggaagcctgaaatgtctttgaagtcttatgtattatcctaaaatccattgacattttatattctaccctacaaaataagtatgtgttactatttttctttccaaattgttgagtaaaactcactgtattcatcctgtgactttgtactgcccagcctagctcattgttttttacctgcctcatttcctgagctgggcattgctcagtttcagaaggtatcaggtgtcattgaacacctgatatgaaggatgtaaaagttctctcttttctatctaggtgtctatattttaattggaggctagatgatatttgcaacctgtctttatctaaagcattgtcagtgaactcacctacttaggaattcatatgcaccttagttaaaaaaaatgtattgtggttttaaattttttcctcaaccantgtaatatgaagaattctttttattttttaagagattctaagaaaatgttcacattatcaaaactagaattctatcaacttttaagacatttaattatttggaataaaatgtgaatttttagacagaaaatggcaaaaactagtatgaaaatatatcatgttacatgtgaaattatgacagttgttaacctattaagttaatcatgttaaatatgtaataatttggggctaaatgaatgtatattataaattatatcagtgaagatcaaccatgtgtntgctttaattattaattttaaagagtgagctctaagaatgaacacatcagatgtnagtattattttaaaaaatcaaaaagaattatctagttattgtatatatgtttttaatattatgactctggtcctttggaatgaatgctattattgcttatctgtatttttttccttttttctttagaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430200 - DNA, 2651 bp, Homo sapiens
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430201 - DNA, 2235 bp, Homo sapiens
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaattta

SEQ ID NO: 430202 - DNA, 1905 bp, Homo sapiens
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaaggattgagaagtcagagcaaggcaataatgtgaagaagaggtcagccagagcaagcgtcctccagttatacagacataaagatagctcactgaatgcacaacttactgctttcatggaattacttttcacctatttttagcaggccagcgaataaaccatttcatgtcttttggtctcattttctcatgaaacataccagtgcaaatgtctccttttctgctaggcagcactgtaaataaaagcatattttacaatcctgttcaaatgacggaaagggttggagcctgtctttttcagatactgtgaggtcacaatgttttctaactagtatttaacaagacaactatttttttaatgaaatttttctttttcttacttcactgttttaagtctcctggttttct

SEQ ID NO: 430203 - DNA, 2767 bp, Homo sapiens
tgggggcgactttgtggggagcctagctgctgctgggcgtttaccgcgggagcccttagcggtctggagctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430204 - DNA, 2829 bp, Homo sapiens
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggccctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430205 - DNA, 2528 bp, Homo sapiens
aaaatagttgcaacatcttttaaaatttaagttgaaacttccactatgtgtatatgaaataatagcaatatagatatttactttacaatttttctattcaaagttgtacagtgactttatttatttcaatagtttttaggggacaggtcgtttctggttacctggacaacttctttagtggttatttctgacattttggtgcacctgtcacccgagcactgtacactgtagccaatgtgtagtcttttacccctcacctccctccctcccttctccctagttcctaaagtcctttatatcaatcttatgcttttgcattttcatagcttagctcccacttatgagtgagaacatacgatatttggttttccattcctgagttacttcacttataatagctgtctccaacttcatccaggttgctgcagatgttccttttaatggctgagtagtattccatgatggatatataccatattttctttatccactcattggttggtgggcatttaggctggttccatatttttgcaattatgaattgcactgctataaacatgcatgtatagttttctatatttgaagttccatactttttggaagattgcttccctgtttataatgtatttgtgtttagagatctgaacaaaacaaaaatgttttaaaattatagtatgaatacttttatgtattttttaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430206 - DNA, 2306 bp, Homo sapiens
attcttcctgtcattgttatttgcatgctgcttggttttataaagttagccaatattatccaagttgtgaaattcctaattcttattttatatttgctcaagaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430207 - DNA, 1647 bp, Homo sapiens
tctattgatttttcatatctaggcacatttccaagtttttttgtcagtaaatttagaaagttttaaaaataatatgtcctgtgtaaatcttaataaggatgttcataattattagtcactagctttgtgaaattcctaaattttagatggtattgcatgaaataaaaaataattattttatcaactttgttaatacatgagttatgtttttataataattctgtagcactggagtataaatgtattctaatgacttataaaatctatatcttttttgctagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430208 - DNA, 1972 bp, Homo sapiens
attcttcctgtcattgttatttgcatgctgcttggttttataaagttagccaatattatccaagttgtgaaattcctaattcttattttatatttgctcaagaatcttaagaagaaggtatttgaaaaggaggcccatatccaagaactttcttgtttgtttcagagtgaaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430209 - DNA, 4752 bp, Homo sapiens
  misc_feature (987)..(987): n is a, c, g, or t
  misc_feature (1466)..(1466): n is a, c, g, or t
  misc_feature (1553)..(1553): n is a, c, g, or t
  misc_feature (3518)..(3518): n is a, c, g, or t
  misc_feature (3796)..(3796): n is a, c, g, or t
  misc_feature (3851)..(3851): n is a, c, g, or t
taaaaagggccaaaacggccaagagacggaaaaaccggctaaaaataaagagccgaaccttgccagggaaaccaaggaggaacaaatgatggttactgataatattaaaaataacaagcaatataagacataacaaataaaaatgttatgatatgccaaataatttattattctgcctctttggatggcatgtattgcattgccatcaaatctcatcaggcactttccctacatattacttttgcaatgacatctgcttaatgaaaattacagatataatctacttgatttcatcctgatatgaatttttcattttttaaagataaacacagtgtaaactattattacaagtgagttttatatctgtcttgaataatgaatattttgttttagaaagttataattttgtagtaaacattcagtattgttagatatacatgtgagatggatgctttagtccactcagccatgaaatgaaaataccaaagtgactgtgcttaattagtcttctgttttttttcctgaatactcatgaaacagtcaattggcatagaatattctgaaagctagcattactcatgattaaattacgtaataactgtctactagataatgacatagagaataatgatactgtgttttttccaggatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaanagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgntgtttgacatacctgagaaaaacaagaaatggggaaaggattccctatttaataaatggtgttgggaaaactggctagccatatgcngaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctgatgttttgttaaacctgataagttttgtactagtaaaattctagaattctaagcatagatttaaacattgctgaaaaatgagtttgtgtgttttatgccttccaggggacagttaagtgggcagtatttatttaatatacctgcttcagccccatttgaattgtaagcactctgaaagcatgtctcatagtcgtctgtatccctggtgtctcccacagtgccctgcttacctgcaggcctttttgtattttctgtccaagtaccctaatagggtggtgcagaatggatgtacagatctgtggatgacctcagcagcttaatccaaggcacccctcgggaagcctgaaatgtctttgaagtcttatgtattatcctaaaatccattgacattttatattctaccctacaaaataagtatgtgttactatttttctttccaaattgttgagtaaaactcactgtattcatcctgtgactttgtactgcccagcctagctcattgttttttacctgcctcatttcctgagctgggcattgctcagtttcagaaggtatcaggtgtcattgaacacctgatatgaaggatgtaaaagttctctcttttctatctaggtgtctatattttaattggaggctagatgatatttgcaacctgtctttatctaaagcattgtcagtgaactcacctacttaggaattcatatgcaccttagttaaaaaaaatgtattgtggttttaaattttttcctcaaccantgtaatatgaagaattctttttattttttaagagattctaagaaaatgttcacattatcaaaactagaattctatcaacttttaagacatttaattatttggaataaaatgtgaatttttagacagaaaatggcaaaaactagtatgaaaatatatcatgttacatgtgaaattatgacagttgttaacctattaagttaatcatgttaaatatgtaataatttggggctaaatgaatgtatattataaattatatcagtgaagatcaaccatgtgtntgctttaattattaattttaaagagtgagctctaagaatgaacacatcagatgtnagtattattttaaaaaatcaaaaagaattatctagttattgtatatatgtttttaatattatgactctggtcctttggaatgaatgctattattgcttatctgtatttttttccttttttctttagaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430210 - DNA, 152 bp, Homo sapiens
ctatatatgcttcttcaagatagaacatctttaaacttggatataacatacaagtaatatctgtttagaaaaaaggtacaatataactgtcaaggctttaaatcatattttaaagaaagcactttattttactcttttgataaaaattacag

SEQ ID NO: 430211 - DNA, 388 bp, Homo sapiens
aggttactctctctgggttgctccctatcttaggattgagaagtcagagcaaggcaataatgtgaagaagaggtcagccagagcaagcgtcctccagttatacagacataaagatagctcactgaatgcacaacttactgctttcatggaattacttttcacctatttttagcaggccagcgaataaaccatttcatgtcttttggtctcattttctcatgaaacataccagtgcaaatgtctccttttctgctaggcagcactgtaaataaaagcatattttacaatcctgttcaaatgacggaaagggttggagcctgtctttttcagatactgtgaggtcacaatgttttctaactagtatttaacaagacaactatttttttaa

SEQ ID NO: 430212 - DNA, 721 bp, Homo sapiens
ttaataaaagaattagacaccttcaaaagtgtaaaactagctttagaacatcttcttagaaagagagactacaaacaagtaaggcatcaacactaagcactcattttaatagtgatatttctcatttgaaggatacattatttttaaactgtagaaattattggtatatttgaaatggaaataatgctttgaattttgtcagtcattaatccccacctttagtgtttcataagtagttgtatatgaacaccacgtttttatagaaaatgtatttttcatctcaaaaactttgtcatacttaattgagctgattctaataaaatatacactttttgagtttaagatctttgtacattatatttatacatatctatatattcttcatctggtaaaagctttattgaaatagaattcacataccatacagttcttccatttaaattataaaattcagtggttttcattgtattcacagagttgtgcagccatcaccacagtcaattttaaagcatttttatcactccaaaaagaaagcttatccctttaaatcacctaaattattcttctgactcccttttggctttttcctatgataaaaattatttcagaattgtaaaaactatctaatattaggtaatagtttttgtaattaaaaagttacatgctcatagaaaattgtgataagcagagaaatattctcttgatctcagcacttagtgaa

SEQ ID NO: 430213 - DNA, 499 bp, Homo sapiens
ctgatgaacattttcatacataaactttttgttgtattgtctttagcttagattcccatgtagaattactgagtcaaagaatatgaacattttgattgttcttgatatgctttgctacatttcttctgaaaaggtattttattactcatactgccattagttctctatacctcatcagcacaggaaataaaatgtgtttttgatttgtagtgtttgctaatttggcaggtaaaaatgttatctatggttttaatttgtaactctttgaggagctagttttaaatttctaaacaatttctatttttattcttctgatagttatctgcatatctgtaaattatatattatactccttggtttatcaaatttagtcaattatattaaccttctaattagtcgagcactaacataattgataatataaatactaatacaactaaaagacatgttaaattcctagtaaataatacaacaaacatataactttatactttcaaaa

SEQ ID NO: 430214 - DNA, 994 bp, Homo sapiens
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggtattctcatcagtatcaggggaaatctaaatttccgattctaggatttcctgttttgtctataatataaattatttgaatcaaatacagcattcttttaagagtatcttttccaaatctagtatttatttattaaaatatatttaatctgattacaagtgtactcatctagcagaattcaactagtttttttgaatcttaatgaaagcaattaaaaatgaaaacctggccgggcgcaatggatcatgcctgtaatcccagcactttgggaggatgaggcaggtggatcacttgaggtcaggagttcaagatcagcctggccaacatggtgaaaccccatctctactgaaaaaatgcaaaaattagccagatgtggtagcgtgtgcctgttgtcccagctacttggaaggctgtggtagaagaatcaccttcgcctcccaggttcaagtgagccgagataatgccactgcactcctgggtgacagagcctgggtgacagagcgagactccatctcaaaa

SEQ ID NO: 430215 - DNA, 2868 bp, Homo sapiens
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430216 - DNA, 2320 bp, Homo sapiens
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggtgtccagccgtccttctgagttttgctagatgcgttaaaagaatgctttggaatgatttcaccagttgagggcactcatgtcagggcttgatttttaaattcccatctacttagttcgtaaaacatcattttcatgcagatactataatactgttttgcaagctattcttttagtattttatggtgaaaaattggtaattaaaattcttattttagtttattcatgcaaatctatagacatttgaagacatggtaatagaatgagagaaggagcaaagttatacttacatatatgttccttgatgtaaggataaggtaaattattgaaacttacattacaaaaattgaatttattttaattagaattgtacgtcaagttttttgggatatttttcagtctgtttctttttcctgttttactttttataccatcagaatatggatcatgtgtatcctgttagtagccacatagccttctcctagctcaatgcctagcacatagtaagcactcaatatttttttaattaatgaaattttttttaaaggagcagtccaaagatggtgacaagtcttttttcttttactttcaaggcagttttaggaagcattccctgtctatcttccaaatatgatctggattttaattttgcaaaaaaaaa

SEQ ID NO: 430217 - DNA, 2453 bp, Homo sapiens
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcacaggagacaatttatccagcatgttgctagaaaatctaactgataatgaaagtgaaaatactaatcttaagaagaaggtatttgaaaaggaggcccatatccaagaactttcttgtttgtttcagagtgaaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430218 - DNA, 2696 bp, Homo sapiens
gccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430219 - DNA, 1864 bp, Homo sapiens
tctattgatttttcatatctaggcacatttccaagtttttttgtcagtaaatttagaaagttttaaaaataatatgtcctgtgtaaatcttaataaggatgttcataattattagtcactagctttgtgaaattcctaaattttagatggtattgcatgaaataaaaaataattattttatcaactttgttaatacatgagttatgtttttataataattctgtagcactggagtataaatgtattctaatgacttataaaatctatatcttttttgctagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagaatatggatcatgtagcagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttcggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaat

SEQ ID NO: 430220 - DNA, 838 bp, Homo sapiens
aaagcaacagacccagcagcaccctcaaagcccaaggtcacgtgagatggggcagagggacagtaagtgccggcaccccatacagaggtggagcctggtgggacagcggcgccattcagaagtacccgtcttcttgccgatgcccacggaggcactgtgtgagcagagtgcggggacctttgtaactggaatagggaaacccaagagacatggcagtaagcacgcgtgtgtgtttccgcggaagatgggaagagccttccagaacaggaaaaagtggttcaaactctagcctggcattgctccccgggagtttggtagaggaggcaatggctaggagcaatttctgccatttcttcatcttttcatgatttatgtcaattattatttcttccttgctggtgttctgcatgaaagatgggcgggtaaaaagtacacttgtagtggacacctctaatttcctttggacaagagctgggtaggaattggccttttgtgactctgcctgcccgaatctgtgtctatccgtatatccacacctagcgttgttaggtgtgacatgaacccctatgcctgcgtgggaatgtgcttattctggggcaggccttcctaaagggccctgggagaaatgaagaactgtggcccagcgaaaaagacatgtgatttacccagactcaactccacacaaaaaatgtcccatgtgtcacatcttatataaactaactcccaaattttcatggcagaaggcatagcagtgaccagccttcacaataaagaaggaaagaagtttgttggaaggattacccagtgagtgctagaacgtgcattgaaccgacgcaag

SEQ ID NO: 430221 - DNA, 1628 bp, Homo sapiens
  misc_feature (1062)..(1062): n is a, c, g, or t
  misc_feature (1259)..(1259): n is a, c, g, or t
agcagtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggtaactgacttttggtttgttttattctttcctttgttccataatagatttgtagaagcctataaacatcaatttcactaatataaaaagtataaatttcaaaaagcaggatctggagagaagtaagcttagtttttaaactcaatatcatgcaaaatagtaggataaggaatataatgttcatagcattaacactaaattatgaattttgtgacaccatgcatggctggaggatcctgtggattatattagctgtcagcttgcatctaatatctctgacagccaatgtcacaagaaaatcataatttacatggtatgtcctgtttttgaagataaaacagattacttcctgggggttgccattatttcatggcactttggtctcaggaaatttcttcagtggttcttcctagagttgatgtggtggatggtgtccagaatagcagccttctcataaattcagatgcaggtttcctgtggctgtttcttgaaggactccttatatactgttacggaatagactaagcaaacagtaaacacagggaccaacacaagttaatttcagccttgtggcagtctggatttaacttggaataaaacctagacatcctgggaatatggcaggattccaggactttcaaatggttctcaatgaacagatagctgaactggtgtttgaatatagatttggagacagggagttgaaagtgatattgtctgaacaggacttggattggagtttacagatttcctttagactttcaccttgtagaaaatgccaagtccttattgtatagtaaataattgaacaaagggagntttggcctttgtgttcaagctaatggagggtgagctctgggcttctggaatatcttgctaatggtagtgtctttgtttgcttgggtcctttggccactggacagcctaaaaatacgaactatgatagatctgtgatctatgataggccagaaacttccagaactagaggctaaagttaaaacctgacttctgggagngtgtggacctaagatcagccacataggtcatctgtgattgtgtcccagtaaagtaagaaagtacacatatcaaaaaataaatttcggctgggcgcggtggctcatggctgtaatccagcactttgggagaccgaggtgggtggatcacgaggtctggagatcgagaccatcctggctcacaccgtgaaaccctgtctctactaaaaatacaaaaaattggtcgggtgtggtggcaggtgcctgtagtcccagctactcgggaggctgaggcaggagaatggcgtgaacccaggagacggaaattgcagtgagccgaaatggtgccactgcactccagcctgggtgacagagagactccatctcaaaaaa

SEQ ID NO: 430222 - DNA, 807 bp, Homo sapiens
agcagtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcaggtgagagaacccacaagacagaaggctatggaagtcacattctagacagtcagagaaggcagcacagctgtgaagggggtttgaggatatgtaaacagttcctctactcatctgtctcccagtgtgagaccagtttttctttgtaggaatttagagttaaaaaaaaacaaaacaaaacaaaaactctttatctcctcagagatctgattattttatctacatattgtttgtttgcctgcataattttcttcttcctcgggtttcaagtatttcccttcttcatgttgttccacctctcttgttacgaaattccaccttccaggcctctttccaaagaggaa

SEQ ID NO: 430223 - DNA, 849 bp, Homo sapiens
agcagtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagagtcttgctctgtgcccaggctggagcgcaatggtgtgaacttggctcaccgcaacctccacctcctggattcaagcgattcttgtgcctatccccaacaccagcaccatacctggcacacggtgatcattcagtaagagtatgtggaatgaatgaatctgttctttggacgaaatgggcctccagcctctggtctgctggtcacagtgaattgcttgtattttaaggtctgttttgcaaggcacatttagaaagcagccaaatctgtctttattattagtgatctaaccttgttttatgctaactgctttcaccttttagtttgtttatactattactttttgccaatgtgcaaggaacattaaacatggagttttatttac

SEQ ID NO: 430224 - DNA, 2349 bp, Homo sapiens
agcagtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgcagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgttgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaattaattccttt

SEQ ID NO: 430225 - DNA, 1976 bp, Homo sapiens
agcagtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgcagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggca

SEQ ID NO: 430226 - DNA, 691 bp, Homo sapiens
aaatgaagactaatgactcatagactgtgtaccatatagtacttaatagatgagcttgcaatgaccatcacctcaattttttaaataacaccaagatccacaagccaaaataaacattgattaaaaagttatgttattcaagataactcagtcttcccaatctcaaagagaaaaaggaaactgagttatcttgaataacataactttttaatcaaatgtttattttggcttgtggatcttggtgttatttaagataactcagtttcctttttctctttgagattgggaagggctgggtctttaaaaacctgaagaggagttggtaagaggaaaaaatcctcaatgctttaaaaaactcaactggttagaagtccatacaactactatgctggcatggacagagatgtttcctgtcacagaactgttcactttcccatagaagtacttcctccaagccaactatataaagatgtaaatcagctcacccatgattgaaactgaaataatccttcaaaatagaagtaagacacctcacccaaaaagatcttttaaatcattgctagctgaactgctattggtcatagtagttggtggctgtgcaaagttctgtgggttaaagaaaggattaccctgcataccaaaagcagattgtcctatcacgttcatctgtgtccccattactgaactgccc

SEQ ID NO: 430227 - DNA, 5588 bp, Homo sapiens
agtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatattcattgaaaatatatacacaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttcca

SEQ ID NO: 430228 - DNA, 5415 bp, Homo sapiens
gagaacgtagtacctttcggggacattggacactactctaggaccgggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatattcattgaaaatatatacacaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttcca

SEQ ID NO: 430229 - DNA, 4963 bp, Homo sapiens
agtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcgcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatattcattgaaaatatatacacaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttcca

SEQ ID NO: 430230 - DNA, 6206 bp, Homo sapiens
  misc_feature (6206)..(6206): n is a, c, g, or t
agtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatattcattgaaaatatatacacaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttccaaaaaaaaaaaaaaaaaaaactaaacaaaacaaacaacaacaaaaaaaaaaaaaaagaagaacagaagaaaaaagaacaaaccagaaagagagaaaaagaaatggaaaaaacagaacaacaaaacagcagagggcagggtcaaaagagtaacagcaagaagaaacgaaaagccgagacaaacaaaacaagatgagaaggagagcacaccaacgaggatcagacctataatgaaaacagcaaacaaggccgacgaaaaagaacgaggtagagaggagcgacaaggaaaggaaagagtaaggtaataatggagacaaagaatataaaggttaggagtaagtaggatgagcggaaaaacagcaagagatatgagaaagagtaagataggatagtaaagtaatatgatgtggtgaggcaaataacaactgtggtcaatatgaatgatgatagtgtaggagctgatgtaagaacattattaagccggaggaagatacgaatagcaaaaatgaataagaagaataaagaagaaggtaagatacgagagtcagataatgataatggaatgatgtaaaagcagagaataaggagagtaacaaagaaaagtgacagaaacgaaaaacn

SEQ ID NO: 430231 - DNA, 3320 bp, Homo sapiens
agtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagccgcctatattaaggcacatttgaataaattctattaccagtt

SEQ ID NO: 430232 - DNA, 1173 bp, Homo sapiens
gtatattttcaatgaatacacaatatatgtaatcaagtgctgtgtattacatatattgtgaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttcca

SEQ ID NO: 430233 - DNA, 257 bp, Homo sapiens
aattgacaaagtttttaacaacattggagcagaccttctgactggcagtgagtccgaaaataaagaggacgggttacagaataaacataaaagagtgagtttccttactgttctttcagccctcttattttatgctgtaggacttcctgtaaaccacagatttttgttgggaaatactgttcagcagcttaacaagaaacatttgtaattatctttctgaaattcctttatcagttaaacatgaccctaacccattt

SEQ ID NO: 430234 - DNA, 749 bp, Homo sapiens
tttgggagatcttacacttttcaaattaaactatgaataaatgcttatatagataagaaatgatcagttctccactatccttctgtttttctaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggtgagttttaattcagcatccacttggaaaaaacccacatgctaagaaccataaaatgcatgtgtgcatttttatgttaagaaatgccaaaagttctttaataggttcttaaatgggttctttagttctcattttatcttattaagtcatacaaaaaaacaaatgcttttaaacatgctctgaatctcctggttacacatatactgtttgacataccatatcatcttgaaatataattttgcttacttaataaacatgtcagttgagcaaacgagtatattagattgtaatatttagtgaagcatatgttttaggatagaaattgccgtgtttcttaaattttcttttcatatttgtcaatatgttactggcaaaatacccagttaaatttttcaacgttaagtgcgtcttagtgcagtcagtgctgggattacagcgtgagccaccgtg

SEQ ID NO: 430235 - DNA, 5383 bp, Homo sapiens
agtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatattcattgaaaatatatacacaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttcca

SEQ ID NO: 430236 - DNA, 4001 bp, Homo sapiens
agtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgta

SEQ ID NO: 430237 - DNA, 5638 bp, Homo sapiens
agtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggaaactgaggctcagagaggtaaaataagtgattcaagatcatataagtggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatattcattgaaaatatatacacaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttcca

SEQ ID NO: 430238 - DNA, 3491 bp, Homo sapiens
ggagggcttttaatctttaagcagcaaaatcacatttttattgaacttatttaaattattgacatttttctatttcagcacaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatattcattgaaaatatatacacaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttcca

SEQ ID NO: 430239 - DNA, 3208 bp, Homo sapiens
cgcggcgcacttggacttccctctccattcgccagccgcctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctggacgcagggctctcccaagttcccaccgagccgaataaaaagcgtccgcccgcagctctccgccaaagacggacattgactccaggactccacagaatggagcaagaatgagaggaaaaaggccggcagaaaagcatgaactggaggtttgttgagctcctctacttcctgtttatatggggccgtatctcagtgcagccctcccaccaggaaccagctgggacagaccaacatgtctccaaggaatttgattggctcatttcagacagggggcctttccaccactccaggagctacctatcctttgtggaaagacaccgtcaaggatttacaaccagatataaaatatacagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtcacagagacacgcactgggcctctgggctgtaacagttatgacaatctggactctgtgagttccgtccttctgcaaagcacggagagcaaactgcaccttcaaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagatttattccctcttta

SEQ ID NO: 430240 - DNA, 2655 bp, Homo sapiens
ggcagctgaagctgcagttccagggacgatgaggactactgtttgtttccaccccttcattctaaagaaacactcaaggaggcccagaaagaacaaatgatctcatttacaaccacagccgggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtcacagagacacgcactgggcctctgggctgtaacagttatgacaatctggactctgtgagttccgtccttctgcaaagcacggagagcaaactgcaccttcaaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagatttattccctcttta

SEQ ID NO: 430241 - DNA, 2798 bp, Homo sapiens
cgcggcgcacttggacttccctctccattcgccagccgcctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctggacgcagggctctcccaagttcccaccgagccgaataaaaagcgtccgcccgcagctctccgccaaagacggacattgactccaggactccacagaatggagcaagaatgagaggaaaaaggccggcagaaaagcatgaactggaggtttgttgagctcctctacttcctgtttatatggggccgtatctcagtgcagccctcccaccaggaaccagctgggacagaccaacatgtctccaaggaatttgattggctcatttcagacagggggcctttccaccactccaggagctacctatcctttgtggaaagacaccgtcaaggatttacaaccagatataaaatatacagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctttataaggacctggagaattcagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagatttattccctcttta

SEQ ID NO: 430242 - DNA, 2316 bp, Homo sapiens
cgcggcgcacttggacttccctctccattcgccagccgcctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctggacgcagggctctcccaagttcccaccgagccgaataaaaagcgtccgcccgcagctctccgccaaagacggacattgactccagggacatccagatcatggagtacacgctggccaacatggccaagtcttgggccgaagcttataaggacctggagaattcagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagatttattccctcttta

SEQ ID NO: 430243 - DNA, 1736 bp, Homo sapiens
  misc_feature (91)..(91): n is a, c, g, or t
gagcgtgctagcagcacagagaagatccataccgcaactgtcccgaccagcattatcggccctcagtctgtactgctcgtcgccaactcantctccacactgaccatgtcttgccttataggtatgatggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagatttattccctcttta

SEQ ID NO: 430244 - DNA, 281 bp, Homo sapiens
cactgctccatccagtcctttcatctttttggcagctccagttcgcattatcagttggataactgtaactcacagacccactcatggtagctaaccttctccaattttcctttatctcccaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacag

SEQ ID NO: 430245 - DNA, 2852 bp, Homo sapiens
cttcatttctatctttactgaaaaattgaagagcaataccttgcactctcttttgaggttattctttttatttgttgcagtgatatgatgctaactaatttaacatgtacacagtaagctctggggctggaagcaaggtcatgcagactgagagagtgccttatcctgtaaaaccttacagcaaaatgacacttgaagaaagtttattttcacatgtaaaattttgactgacaaaaggaacctactactttaaacaatggttttattagaacatggtcagcaaatgtatcatgcctctgcaaattttagtgatgtttagagatgcctctaagtttgcagttggaggtttttgtgcttttagaaatgtgatgtgatccttagggtacctgttttgtctgttgtgttgagaaccaaacccattgaacaacttaaaaaattgggaaataattgtcagctattttgtatacatacacacaaaatatatacattatataatatgtatattatgtattatataatatatataaaatgttttgtatattttttacatatctgttaaaaaatgtactttgtttttttgtttgtttgttttgagatggagtctctctctgtcacccatgctggagtacagtggcgcgatctcagcccgctgcaacctctgcctcctgggttcatgcgactctcgtgcctcagcctcccaagtagctgagattacagttgggtgccaccatgtccggctaatttttgtatttttagtacagatggggtttcaccatgttggccagggtggtctcgagctcctgacctcaagtgatccacccaccttggcctcccaaagtgctgagattacaagcatgagccactgcacctagccaagaagtgtactttttgtttaatgattaccgaaagaagttctcctttagaagcattgacttatacaaattcccacattcacctcagttaatatcttcctttaggattcttggataatagaaattcttcctaaaacatactcagagatgcagctcattattaaattaaggtaaccacattctgtattgttgctagcttttcatgtaaacattattcacactttaaaggattaggtgtttaaatattgatggtcatctttgtctggtgttaggtgccagacacctggctgctgaatttgttttttccctcaccaaagttgtcatttggaacgccagctgggaggactttgaaggaaaagaaaatatatgacaataggcagtattgacacattgtttaaaatctttttcacaataaaacaaaacacccaagttgtcatattgttaaagttggaaatctataggtttttctttttttttttttttttctttttttgattctagatttcatggccagaacacaaattcacgtttcttgtcctaggacagggaattggtgacaaaatggattatactattttaataacagtggaaactttcaaactacatgtgtttacaccaaattcttggcttctcaaagcaacatgaattaaagcacagtatcaaggtgatgccctatgacaatgtttcaacacacacttgaaattttaagagaaatttcagttcttcactcaggaaatgtgctgtattctctaatgtactttcatgctgcagcatggagcctctttaaacagctttgggataattatagcagcacaagaagtttatctgcaaaatatttcaatcatcttggtacaatagatgacttttacatcatgtatattagccttatgtgatataaaatgtattacttagaaaatatacttaaaggaattatttctattataaatggtattcatgattgactacttaattaatgcacattagatttctcctaatataaaatgaaatgatgcagtttagttcatttcagtctagatgcccgtactaacaagaatacagttagataagttcattgtatctcaatgaagaatcattgaacttgaaacccaagtcccaaatgaatctgcaggaatgagcagtgctctgcgggggcaaacagccccagaggtcccagggttcttcctaggtaatgagagtatagctgtgatcaaggaaatgtgaacttctcttttgggaagatctgcgataattagctttatggaagcgaaaatggtttagagtggtgttgagcaattgttaagagttgaaatagacacacacatgcatgtgcttttgggaaacatgatgtgccaacgtattaatgtgcctgagggctccttgtggataggtcagtgtccacatttcagcactcagggcatgactgtacacaacctaagactatatatatattttttcattttcaaatgtacaaatacccatagaggtgatgtgcctggataagtcatttaaccatagcttagtgaaataaatgtgatggccctaaaaagtagaattttcactttcattacagccatgcctttattatgcagtctccatttctgtgtgatatttggtaatatcacatgtcaaatacatcaggactttgtttattttggctaactctaactatacaattgctgaacatagctttctgaaatagaaattataagagaaacccagtatgcctacagcattagtagcctaaatcctagattctagaatccaataaatttatagtagttcttaagaagtttcctttaaagcaacaaatagattattaaggcaaatttagataataacccaagttagcaataaaaccatgtgacattatagattatgtccagatactaactgctttgaccataatatcccaatgacaataaaaaatgatccttggtttaaaaattattaaatggtacttatttttatgtataacaagtg

SEQ ID NO: 430246 - DNA, 1813 bp, Homo sapiens
cttcatttctatctttactgaaaaattgaagagcaataccttgcactctcttttgaggttattctttttatttgttgcagtgatatgatgctaactaatttaacatgtacacagtaagctctggggctggaagcaaggtcatgcagactgagagagtgccttatcctgtaaaaccttacagcaaaatgacacttgaagaaagtttattttcacatgtaaaattttgactgacaaaaggaacctactactttaaacaatggttttattagaacatggtcagcaaatgtatcatgcctctgcaaattttagtgatgtttagagatgcctctaagtttgcagttggaggtttttgtgcttttagaaatgtgatgtgatccttagggtacctgttttgtctgttgtgttgagaaccaaacccattgaacaacttaaaaaattgggaaataattgtcagctattttgtatacatacacacaaaatatatacattatataatatgtatattatgtattatataatatatataaaatgttttgtatattttttacatatctgttaaaaaatgtactttgtttttttgtttgtttgttttgagatggagtctctctctgtcacccatgctggagtacagtggcgcgatctcagcccgctgcaacctctgcctcctgggttcatgcgactctcgtgcctcagcctcccaagtagctgagattacagttgggtgccaccatgtccggctaatttttgtatttttagtacagatggggtttcaccatgttggccagggtggtctcgagctcctgacctcaagtgatccacccaccttggcctcccaaagtgctgagattacaagcatgagccactgcacctagccaagaagtgtactttttgtttaatgattaccgaaagaagttctcctttagaagcattgacttatacaaattcccacattcacctcagttaatatcttcctttaggattcttggataatagaaattcttcctaaaacatactcagagatgcagctcattattaaattaaggtaaccacattctgtattgttgctagcttttcatgtaaacattattcacactttaaaggattaggtgtttaaatattgatggtcatctttgtctggtgttaggtgccagacacctggctgctgaatttgttttttccctcaccaaagttgtcatttggaacgccagctgggaggactttgaaggaaaagaaaatatatgacaataggcagtattgacacattgtttaaaatctttttcacaataaaacaaaacacccaagttgtcatattgttaaagttggaaatctataggtttttctttttttttttttttttctttttttgattctagatttcatggccagaacacaaattcacgtttcttgtcctaggacagggaattggtgacaaaatggattatactattttaataacagtggaaactttcaaactacatgtgtttacaccaaattcttggcttctcaaagcaacatgaattaaagcacagtatcaaggtgatgccctatgacaatgtttcaacacacacttgaaattttaagagaaatttcagttcttcactcaggaaatgtgctgtattctctaatgtactttcatgctgcagcatggagcctctttaaacagctttgggataattatagcagcacaagaagtttatctgcaaaatatttcaatcatcttggtacaatagatgacttttacatcatgtatattagccttatgtgatataaaatgtattacttagaaaatatacttaaaggaattatttctatt

SEQ ID NO: 430247 - DNA, 2572 bp, Homo sapiens
tcagtcacagctcccatgcctcagctttgtacctgttttcaaaagcacaactgaggtgtgcgggctggagctgtcttgcagtgattctggccttctggctcatggttcagtccagcagcctggctgacccactatttctcctctgcttcagaggaaacccaggaaatgcccttactgccaggctgagtctccacccatgctggttggtgctggctaggctgagggggccaccacttttcctggctagaagctacttgacctttgatgtttgagttctgtaagtcttcgtgttctgacttactgcttcagagggattggcctgtcccctttccctttctcggctatgggaaggaaggattgctcattggttgccttcatcagttacagcatgagacggaattcatcattccttccgaaacccctgatatttaatatttaatatttaaaaacccaaattatcaaaccattaagaactcattactggttctcagcctcctccagtactagcctcagtgtggctgctgcataagtatctgtagcctgtctacctcctgcagtggggccgctcgcctcttccctgtctactgctcaggctctcccacttcgtggcatccatgtaaagtaggtggcagggcagagatgtcactctcattcaacagggaggatgtctgttgctcagagaggttgtcctgaggggctgggtgattcctgggcctacattcttcccgaggctccaggccgctgtctctggaagtaaaagagccttgtctgaccttaatgcaagcagtctgtttgaacccctgtaggctgcattcaggagacagaaggtgtctgggccatcctgggcggccggtcagcgttgctaggcaggctcggctgtctggccgggacttgggcctgggtggcttttgagaccagtgaagaagggagagccggcctcatgccgatgcggcttgtggcacggctgggatgtgagggaggactcagatctacacacagaaacccctcttctccccgccctcccccagctcctacctgcctcccacgcctcaggtgtggctgcctgtgggaccatcccccaacccctttcctcgcacctccttgtcctcacccagttcctgcagtgtctctgacccacgcctcccgcctcctggccgacttgcccaggaggtgtctctggctcacctccgtctgttcatcaccttcctccccagtgtttccacttatcttggatgttttagattgaaacagcctgattcccggaagaatcctcttcattcattgctagtgcttcccctcacctcccactctccacttcccagtttgcaaatgtggctttcgcccaccaagtgaaagcggactgagagcagcccttggggacggcccggtgcctggctgcaaggccgcgctggggctctgtcttggtgcacatggcttgaccggactttccctgcttcccaccacttccctcactcccagacctccctcattctttttgtctcttctttttgcctaaagccagtccttaacaccctattcttcctctgcaggtggcttgcagacttttccccacctttggggctcgtggtggtggagagggcagctggtgttaagaatgtaggttaccgggcatgacccggcagatgcttgcccagtagttctggaggaaggcccgggaatctgcaaatgagcgcattccccaggcagttcccatgcaggtgatccacggaccacatgttgagaaactgcagtcacccttagggccacaccgtccctctccccgctgtcccctctctgtagtgactggccctgaccttcaggagtgcactttccactctaccaggaagccctatgacatcctcaggctccccagacctgcagcttgcatggggcccctcccttcttccacacccaccctccgtatggtcccctgctctgccctcgtgctttgctggcccctgcccgctactcccactctcagacacccaggggtggtgggccctaactggctggcccctcccagcgctgccctctgccgtccagatgctgcagtgtggccagatttaccttccagtaacatacttctagtcacccctcctcctgcgaagtgatctgcagtggctgtttgaccagaccacaaagttcacatctcctgagcttagtgtccgtggctgtccacctcccagccatacttgactgtccccaaactctccctgcagccacatgtttcccatgacctgtgggctctgcagatggacctctctccgctagagatgcccttctcccaaatggcttccctcctggaaggcccagcctgagtcctcgtctcctttccagtgcttctgccagaagcatccccatgatgttgtgaccgcacagcactttgtgtctcgctttgagcacttgccactctggctggtgctgctgccactgattgtgtactgtcttgctgccctttctagactgtgagctcctcgtgggcagggaccgcctgtgttctctgtatttcccacggcgcctagcacagtgccttgcacttgataggtgcttaataaatgtctgctcaactgaa

SEQ ID NO: 430248 - DNA, 3352 bp, Homo sapiens
ggcccggcccgcggcggcggcaaaggggcggaggggttcgctgccagcaattgccaagctgctgcggtcgtggcgggatggtatagccgggcctgagggcgggcggcggggcgcgggcgggggcgaggcggccgggaagggccgacgccgcctgactggcttgggagcagcggcagcaagctgagggggcgtcgccgccgccggcccccggcgccgccgcgggaggccgcgcccgccatggcggcccgggcggtgctggacgagttcactgcgccagctgagaaggcggagctgctggagcagagccgcggccgtatcgagggcctgtttggcgtgagcctagccgtgctcggcgcgctaggggctgaggagccgctgcccgcgcgcatctggctgcagctctgcggggcgcaggaggcggagcacagcgccaaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacaaatgataatttcagagaatttgtgaatgagtcagtctcttggagagaaattattacaaaaaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccaccaatacagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtataaaaaaaaaa

SEQ ID NO: 430249 - DNA, 697 bp, Homo sapiens
tgccgttgttcatacctgcatgttgttcatgggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtataaaaaaaaaa

SEQ ID NO: 430250 - DNA, 482 bp, Homo sapiens
gacagtctttaaatcttatttttcaaagttatattgaaagttatattagaagaagaagcggcttcctaagcccagtacaaatctgcaagtcttaatgagaaatttgagggccagctgataaaacgttctgactattgtttttgtgtccaaaacagaaattaaaagggtttgacttgggtgttttccccgcttttaggcagttgagcagtcttaggatttgtaggctgacctgaccgttgctttggcatcaggtggctgctttgggatccttacgcaggccctgggcagtgaggaccctgtctctcagcctcatggtgttctgtgttgtaggctgctgcagtacacgttcgtgggggacatatttatggttcccgatgatcctctgggaagaagtggacctcgattagaggagtttcttcagaaggaagtctgtcttaggtatttcctttttcagattgtcttgtattaaaacttctatttca

SEQ ID NO: 430251 - DNA, 414 bp, Homo sapiens
tcccggggagaaaatgggcagaacacaaaacagctttaaattgaatttgagagaaattattacaaaaaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccaccaatacagcctccgacccggattcagatacagaccagttacacttgaattaagatctgcgctcaaatctcctcccacctctctccctgcttttgcctcgctctgacttccatctggtatttccgattcacaaagcactttcctcccc

SEQ ID NO: 430252 - DNA, 2592 bp, Homo sapiens
ttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacaaatgataatttcagagaatttgtgaatgagtcagtctcttggagagaaattattacaaaaaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccaccaatacagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtataaaaaaaaaa

SEQ ID NO: 430253 - DNA, 1053 bp, Homo sapiens
  misc_feature (2)..(2): n is a, c, g, or t
gnccactctagattatcccctgtattggtggtgctccctcatagagcgcattgattccctggcacgccttgaggtgatgtcagtgaaatccccgcaggctcctctgtgggtgtctcatggcaccatctccacctcagtcttgcatcctgcctttggaagccagggagcggcatcctgagcctcaaggcctgccgcaggtaccttctaaaatagctctatgattttttgtttacttataacccaactcaccaggactcacttccattcacagagatatgcagcccctactcagtgccctgccaaatgtgggcatgtttgaccccagcttcagagtccctggcacccaggcagccagcaccaccaatacagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtataaaaaaaaaa

SEQ ID NO: 430254 - DNA, 3255 bp, Homo sapiens
ggcccggcccgcggcggcggcaaaggggcggaggggttcgctgccagcaattgccaagctgctgcggtcgtggcgggatggtatagccgggcctgagggcgggcggcggggcgcgggcgggggcgaggcggccgggaagggccgacgccgcctgactggcttgggagcagcggcagcaagctgagggggcgtcgccgccgccggcccccggcgccgccgcgggaggccgcgcccgccatggcggcccgggcggtgctggacgagttcactgcgccagctgagaaggcggagctgctggagcagagccgcggccgtatcgagggcctgtttggcgtgagcctagccgtgctcggcgcgctaggggctgaggagccgctgcccgcgcgcatctggctgcagctctgcggggcgcaggaggcggagcacagcgccaaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacaggtttctactacacttagcggacaaaactggtggcataattgtgacaaatgataatttcagagaatttgtgaatgagtcagtctcttggagagaaattattacaaaaaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccaccaatacagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtataaaaaaaaaa

SEQ ID NO: 430255 - DNA, 1830 bp, Homo sapiens
taatcacctatatcagagcttcaaagatccttaatttccccacagacttcctcagcaaaaggactacatgtgggaaatcaatgaaaacaggaatgagaagagaaagttaaaaattggttgcttttgttcctgccattggggcccaatggcagccgtacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacaaatgataatttcagagaatttgtgaatgagtcagtctcttggagagaaattattacaaaaaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccaccaatacagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtataaaaaaaaaa

SEQ ID NO: 430256 - DNA, 1146 bp, Homo sapiens
caaaatcaaaatcttcagaagagtaagacactgttaaaccttttgaaagctcccaagggtaccctggttagagccaaacagctggatggggtcagtcctcacagcagaagacctgggagggtggtgctccctcatagagcgcattgattccctggcacgccttgaggtgatgtcagtgaaatccccgcaggctcctctgtgggtgtctcatggcaccatctccacctcagtcttgcatcctgcctttggaagccagggagcggcatcctgagcctcaaggcctgccgcaggtaccttctaaaatagctctatgattttttgtttacttataacccaactcaccaggactcacttccattcacagagatatgcagcccctactcagtgccctgccaaatgtgggcatgtttgaccccagcttcagagtccctggcacccaggcagccagcaccaccaatacagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtataaaaaaaaaa

SEQ ID NO: 430257 - DNA, 2606 bp, Homo sapiens
ggcccggcccgcggcggcggcaaaggggcggaggggttcgctgccagcaattgccaagctgctgcggtcgtggcgggatggtatagccgggcctgagggcgggcggcggggcgcgggcgggggcgaggcggccgggaagggccgacgccgcctgactggcttgggagcagcggcagcaagctgagggggcgtcgccgccgccggcccccggcgccgccgcgggaggccgcgcccgccatggcggcccgggcggtgctggacgagttcactgcgccagctgagaaggcggagctgctggagcagagccgcggccgtatcgagggcctgtttggcgtgagcctagccgtgctcggcgcgctaggggctgaggagccgctgcccgcgcgcatctggctgcagctctgcggggcgcaggaggcggagcacagcgccaaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacaaatgataatttcagagaatttgtgaatgagtcagtacttgccactctggctggtgctgctgccactgattgtgtactgtcttgctgccctttctagactgtgagctcctcgtgggcagggaccgcctgtgttctctgtatttcccacggcgcctagcacagtgccttgcacttgataggtgcttaataaatgtctgctcaactgaa

SEQ ID NO: 430258 - DNA, 1220 bp, Homo sapiens
gacagtctttaaatcttatttttcaaagttatattgaaagttatattagaagaagaagcggcttcctaagcccagtacaaatctgcaagtcttaatgagaaatttgagggccagctgataaaacgttctgactattgtttttgtgtccaaaacagaaattaaaagggtttgacttgggtgttttccccgcttttaggcagttgagcagtcttaggatttgtaggctgacctgaccgttgctttggcatcaggtggctgctttgggatccttacgcaggccctgggcagtgaggaccctgtctctcagcctcatggtgttctgtgttgtaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccaccaatacagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtataaaaaaaaaa

SEQ ID NO: 430259 - DNA, 2629 bp, Homo sapiens
ggcccggcccgcggcggcggcaaaggggcggaggggttcgctgccagcaattgccaagctgctgcggtcgtggcgggatggtatagccgggcctgagggcgggcggcggggcgcgggcgggggcgaggcggccgggaagggccgacgccgcctgactggcttgggagcagcggcagcaagctgagggggcgtcgccgccgccggcccccggcgccgccgcgggaggccgcgcccgccatggcggcccgggcggtgctggacgagttcactgcgccagctgagaaggcggagctgctggagcagagccgcggccgtatcgagggcctgtttggcgtgagcctagccgtgctcggcgcgctaggggctgaggagccgctgcccgcgcgcatctggctgcagctctgcggggcgcaggaggcggagcacagcgccaaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacaaatgataatttcagagaatttgtgaatgagtcagtctcttggagagaaattattacaaaaaggtaatattttcttctttgtctttggtcagaaaagttttgtttttaattgtttgtttctgtgtgcattttgttcgttttgttttctatattccttggctccacagaaggcaatataggggaccaaagtatcataagactgtgctgcactcccacttcataggtggctg

SEQ ID NO: 430260 - DNA, 1253 bp, Homo sapiens
cttttgtccgggtaacggccgaggcccgggcggccccccggtgcagacggacagtcgggcggccgcccggaaggaggacgccccaggcctcggcagagctgggccggagggcggagccgctccgggcgagtggtccgagggtccgcgtgcctggtgggcggtcggcggcgtgcgcacacgtccatgtgcatttgtgtttacgcacgcaccgcgccacggcgtcggccgggcaccggggaggtggcggacctgcgggcacgttggcgcgcgtgtgaacgcgcagccccctggtgcgtttggtgtgtgatcaacgcgtacacatgtggcgggtgtgcagatgccgcccgtgcccggcacggtgtgatgtgtgtacacggcctggagtgtaggggtggcgtgtcggagccccacactacaccacagggatgagcgtgtatccccttcagaggtgtgcctggggactccgtgtgcgcgactaggtgctctcctggggctggcaggggcatctgtccctttaccggtgcaatggggagggtgcacacggttcaccagctttcgggctagctgggtaggaggtgatgctgccccggtctggcacccactcccccgggcctctcctaacccataggacagtagtgctcctggcttgtgctgcccagaggctacctggctttccctaattcaccgaccccaggattaaccccatggtggttggtatcaggggatgaggccagagccctttgagctgtgcccctcacaggggtagggtcatggcctcagccatcccggtaccatctgtgcccagccggggactgggaacctggtttctccatgaggagccatcccagggcctgcaggagggactagaagccagaggactctgaggctccgcttcctggggactgcagggggatcagaatgtcccaagcttgggacagtctgggaaggcagtggccatcccatccagatgagtacatccctctctccttgcctacttccctcctaccagccgtcgcggaggccactgatcctgtgtggtgttcaccccaggacgtgggaggctgctctgtccctctggccttagtttccacatctgtatggtggggttggggggcatgagtcagcttctgttggccagcttactgccccctgtgccccaaggcagccccacccggaggaagctccctgcttccctcctggtctccacagccctcatcagccctgtttgtgtcaggggctggatgtggcaaaac

SEQ ID NO: 430261 - DNA, 425 bp, Homo sapiens
gcggcagggccggcgggggcctggagggtgagcaggggcctttcttcctgcagacagccctcagcgcctttttccaggagaccaacatcccctacagccaccatcaccaccagatgcacgcctggctagtttttgtatttttagtagacacggggtttcaccatgttggccaggctggtcttgaactgctgacctcaagtgatccacctgccttggcctcccaaagtgctgaggcaggagaattgcttgaacgtgggaggcggaggttgcagtgagccgagatcgctccattgcactccagcctgggcgataagagcaaaactccgtctcaaaacaaacaaaatcccagcgtagtggctcccgcctgtaatcccagctactcaggagactagcctgggcaacacagggagaacctgtctcttaaa

SEQ ID NO: 430262 - DNA, 1404 bp, Homo sapiens
aactataacagcgtctagtgagcaggctcggtggttatcgctaatggtggacgcgtgaggcggaggcgcgggcggcggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgagacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagagcggcctgggtgcctggcggacagaacttcagagaccacgcagccttccttcgaagacgcacctgcccagcccagcccaggggtgccgtggaggaccaccctggcggagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccacaaaaaaaaaa

SEQ ID NO: 430263 - DNA, 1604 bp, Homo sapiens
tccccagttctggattgggcggaaggaggccgagctagttctgtgtataagcagcccctggccccggtgtacgagggcgctggtgcaggcggggctcgacctctttggagatgggtcagcaggagtcccggctccgtgggtcctgcacttaatcttgcctgtgccagctccccctgagacctggggggcgctggcctctggggcaatgaagctccttaccctacagcccccggggatgctgtggctgatggaaaggggtgggctgggaaagcctcgtggccccaggcaccgtgggctcctgagagtgaggctgggtcggttcatctcaaggcttctcctctgggaacccctgggcggcggacaggcttggggatctggggaaggaacacagagccttccgagaatgggccagccacgcatctccccttgggaggcagtgggggcccctccaggaaggggtgctcaccccatctctcctctcttcccctcacagatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagagcggcctgggtgcctggcggacagaacttcagagaccacgcagccttccttcgaagacgcacctgcccagcccagcccaggggtgccgtggaggaccaccctggcggagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccacaaaaaaaaaa

SEQ ID NO: 430264 - DNA, 629 bp, Homo sapiens
cacgccccttcccgggcttcgcgtcccctagggtgccggccccgctcccccggggcgcccggcgcaccgtggggactacatatcccagcatgccgcggcgccggcggagcgaggcgaggcgcggtgagtcagagccgcacagtaaatatttgtattagccggagccggctcgctaatggtggacgcgtgaggcggaggcgcgggcggcggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgagacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgcatccacttcctttcccccttttaacaaaagagaagaacgaattccaaaccacaaaaaaaaaa

SEQ ID NO: 430265 - DNA, 512 bp, Homo sapiens
cacgccccttcccgggcttcgcgtcccctagggtgccggccccgctcccccggggcgcccggcgcaccgtggggactacatatcccagcatgccgcggcgccggcggagcgaggcgaggcgcggtgagtcagagccgcacagtaaatatttgtattagccggagccggctcgctaatggtggacgcgtgaggcggaggcgcgggcggcggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgagacagccctcagcgcctttttccaggagaccaacatcccctacagccaccatcaccaccagatgctcccctgcacctgggggtacccgcatccacttcctttcccccttttaacaaaagagaagaacgaattccaaaccacaaaaaaaaaa

SEQ ID NO: 430266 - DNA, 1536 bp, Homo sapiens
cacgccccttcccgggcttcgcgtcccctagggtgccggccccgctcccccggggcgcccggcgcaccgtggggactacatatcccagcatgccgcggcgccggcggagcgaggcgaggcgcggtgagtcagagccgcacagtaaatatttgtattagccggagccggctcgctaatggtggacgcgtgaggcggaggcgcgggcggcggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgagacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagagcggcctgggtgcctggcggacagaacttcagagaccacgcagccttccttcgaagacgcacctgcccagcccagcccaggggtgccgtggaggaccaccctggcggagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccacaaaaaaaaaa

SEQ ID NO: 430267 - DNA, 1622 bp, Homo sapiens
cttttgtccgggtaacggccgaggcccgggcggccccccggtgcagacggacagtcgggcggccgcccggaaggaggacgccccaggcctcggcagagctgggccggagggcggagccgctccgggcgagtggtccgagggtccgcgtgcctggtgggcggtcggcggcgtgcgcacacgtccatgtgcatttgtgtttacgcacgcaccgcgccacggcgtcggccgggcaccggggaggtggcggacctgcgggcacgttggcgcgcgtgtgaacgcgcagccccctggtgcgtttggtgtgtgatcaacgcgtacacatgtggcgggtgtgcagatgccgcccgtgcccggcacggtgtgatgtgtgtacacggcctggagtgtaggggtggcgtgtcggagccccacactacaccacagggatgagcgtgtatccccttcagagacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagagcggcctgggtgcctggcggacagaacttcagagaccacgcagccttccttcgaagacgcacctgcccagcccagcccaggggtgccgtggaggaccaccctggcggagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccacaaaaaaaaaa

SEQ ID NO: 430268 - DNA, 1297 bp, Homo sapiens
cacgccccttcccgggcttcgcgtcccctagggtgccggccccgctcccccggggcgcccggcgcaccgtggggactacatatcccagcatgccgcggcgccggcggagcgaggcgaggcgcgacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagagcggcctgggtgcctggcggacagaacttcagagaccacgcagccttccttcgaagacgcacctgcccagcccagcccaggggtgccgtggaggaccaccctggcggagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccacaaaaaaaaaa

SEQ ID NO: 430269 - DNA, 719 bp, Homo sapiens
  misc_feature (28)..(28): n is a, c, g, or t
tggtggtcagaaggatccctttgcgatngaattgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcaccaaagtgagactattactatcgagtcttattccatcgccatctaaatactcctg

SEQ ID NO: 430270 - DNA, 1700 bp, Homo sapiens
  misc_feature (5)..(5): n is a, c, g, or t
gcganagcagaggacgagccgggacgcggcgccgcggcaccagggcgcgcagccgggccggcccgaccccaccggccatacggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggtgagtcctcagcaccaggggcagcctcttctgggcccaccagcataccctgagagtcagggacttggctctccagcaggtcccaggaaggatggtctgggtcgtggctaaaggtctgcttgccaaggctatggcctggaggctactggctggatgcagcctgcgcatatgttttatttggcccatagagtgttttaaacatttaaaaaattagttgccagtatttaaaaatcaaaaaatttcacataaaaatctggagttttggcttctcatgaaaaaaaaaaaagctagatctggcaacagcgggctttcataacgccaacgattgctagactgggataatggcggtccctccatcgccttctgtggctggttgtgggccttagttttctgcagctctacctggcctgcttactctcccacgtgccatgcagttcctgggggttgctgtatttgtagcccctggcctgggcactcaagggcagcagataccctgtttgcctccctgagtgcagaggtcctgagcccaccctagttgggctgactcaactggaaatttggttgtgacagtggcgtggggagagggctgggtgattgtattctgtgtactgcccagcccaggcctcttcatctggggactttttggcctaaccctggaagcctggaaagttgcccacttttctctttcaggttaagccagcaatttcagggccaaccgagctgtaaacatgttagtaatgaggacaactagcatttgtacagggcttcacagtttacaaagcgctttctcatacattatcacatttgatcctcccagggccctgccaggttgttttgcatatgtgcattttaatttcaaaaagtcttccttccaagcgtgtatgatgaaatgagtaaattgattaattggcgtaacttattttgcatggatccaacctaatgttcatgcaggatagagaacatttccagaatacaaatttccaaacttattaa

SEQ ID NO: 430271 - DNA, 1779 bp, Homo sapiens
gcagtgggctctggcggaggtcgggagaactgcagggcgaaggccgccgggggctccgcgggctgcggggggaggcacttgacaccggcccggggagaggaggggccgctgtccctgcggccagtgctggatgcggggacccagcgcagaagcagcgccaggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggtgagtcctcagcaccaggggcagcctcttctgggcccaccagcataccctgagagtcagggacttggctctccagcaggtcccaggaaggatggtctgggtcgtggctaaaggtctgcttgccaaggctatggcctggaggctactggctggatgcagcctgcgcatatgttttatttggcccatagagtgttttaaacatttaaaaaattagttgccagtatttaaaaatcaaaaaatttcacataaaaatctggagttttggcttctcatgaaaaaaaaaaaagctagatctggcaacagcgggctttcataacgccaacgattgctagactgggataatggcggtccctccatcgccttctgtggctggttgtgggccttagttttctgcagctctacctggcctgcttactctcccacgtgccatgcagttcctgggggttgctgtatttgtagcccctggcctgggcactcaagggcagcagataccctgtttgcctccctgagtgcagaggtcctgagcccaccctagttgggctgactcaactggaaatttggttgtgacagtggcgtggggagagggctgggtgattgtattctgtgtactgcccagcccaggcctcttcatctggggactttttggcctaaccctggaagcctggaaagttgcccacttttctctttcaggttaagccagcaatttcagggccaaccgagctgtaaacatgttagtaatgaggacaactagcatttgtacagggcttcacagtttacaaagcgctttctcatacattatcacatttgatcctcccagggccctgccaggttgttttgcatatgtgcattttaatttcaaaaagtcttccttccaagcgtgtatgatgaaatgagtaaattgattaattggcgtaacttattttgcatggatccaacctaatgttcatgcaggatagagaacatttccagaatacaaatttccaaacttattaa

SEQ ID NO: 430272 - DNA, 497 bp, Homo sapiens
tcggtaccctttgcgatggaattgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgtccaaccctgtgatgattgatgccaaagaagtgtcagctgcacacagggcccgctacttctggggtaaccttcccggtatgaacagttcagcaaagtgaggaccattactacggaggtcaaatccatcgcaaaggtaacctctagggtagca

SEQ ID NO: 430273 - DNA, 4301 bp, Homo sapiens
  misc_feature (5)..(5): n is a, c, g, or t
gcganagcagaggacgagccgggacgcggcgccgcggcaccagggcgcgcagccgggccggcccgaccccaccggccatacggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 430274 - DNA, 3842 bp, Homo sapiens
  misc_feature (5)..(5): n is a, c, g, or t
gcganagcagaggacgagccgggacgcggcgccgcggcaccagggcgcgcagccgggccggcccgaccccaccggccatacggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgt

SEQ ID NO: 430275 - DNA, 4652 bp, Homo sapiens
  misc_feature (5)..(5): n is a, c, g, or t
gcganagcagaggacgagccgggacgcggcgccgcggcaccagggcgcgcagccgggccggcccgaccccaccggccatacggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgtactggtgctttcctgtctaagtcgccttttgtgtgttcttttatgaggcccccaccatccacccctctgtgcacaaggcggctcccggcccctggaatgtgatgtttttggtcatctccaaaggctgcagttttatactgggaggctgatgacaccttttattataattattcttatggttctggttataattatgtttgttttaagattttctttaagaaaacaaaaacccaacacccttccctttaggtttcaaaccaaggtgcgggagcagggtgcttctgagttagcggtggctctggtgccctggctcccacccctcgggccaggtgggccactgggcatggtgaca

SEQ ID NO: 430276 - DNA, 3561 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 430277 - DNA, 3337 bp, Homo sapiens
ccgattttgctctgtcttgcctcattcagatggagctccctcctggctgtcctgccccccagatgcccagggctggggttgccatggggggatcagggtggcagggcctcgtgaccactgtgtaatgatttctgctccttggggctccaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 430278 - DNA, 2224 bp, Homo sapiens
  misc_feature (28)..(28): n is a, c, g, or t
tggtggtcagaaggatccctttgcgatngaattgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 430279 - DNA, 2233 bp, Homo sapiens
  misc_feature (26)..(26): n is a, c, g, or t
  misc_feature (42)..(42): n is a, c, g, or t
atgtgatctcgcgttctagaggatcnctttgcgatggaatangaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 430280 - DNA, 3631 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacaggctcacctgccgagaccagggtgccagggagatggctccaagtaacggtgctgtctgctggctggtgcagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 430281 - DNA, 3412 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 430282 - DNA, 2050 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcgcaaagtggaggaccattactacgagtcaatccattgcataagtccgtga

SEQ ID NO: 430283 - DNA, 2064 bp, Homo sapiens
  misc_feature (2002)..(2002): n is a, c, g, or t
  misc_feature (2005)..(2005): n is a, c, g, or t
  misc_feature (2008)..(2008): n is a, c, g, or t
  misc_feature (2011)..(2011): n is a, c, g, or t
  misc_feature (2018)..(2018): n is a, c, g, or t
  misc_feature (2027)..(2027): n is a, c, g, or t
  misc_feature (2031)..(2031): n is a, c, g, or t
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttagnaantgngancatatangagtcaatncatncaaggtccgaccgatcgatcagcaaaaaataaa

SEQ ID NO: 430284 - DNA, 2048 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcatagtgtgtcattacttcggggtctattccatcgcaatagagatc

SEQ ID NO: 430285 - DNA, 1844 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgtccaaccctgtgatgattgatgccaaagaagtgtcagctgcacacagggcccgctacttctggggtaaccttcccggtatgaacagttcagcaaagtgaggaccattactacggaggtcaaatccatcgcaaaggtaacctctagggtagca

SEQ ID NO: 430286 - DNA, 1483 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggaccttcccggcccctggaatgtgatgtttttggtcatctccaaaggctgcagttttatactgggaggctgatgacaccttttattataattattcttatggttctggttataattatgtttgttttaagattttctttaagaaaacaaaaacccaacacccttccctttaggtttcaaaccaaggtgcgggagcagggtgcttctgagttagcggtggctctggtgccctggctcccacccctcgggccaggtgggccactgggcatggtgaca

SEQ ID NO: 430287 - DNA, 436 bp, Homo sapiens
tggggctgtcgccctcagcctggtgctggtggatctggctcaggaccctcggcctgggaggattggggcaggggtcaggacttgaggattaccccgggaatccctcctgagtaacctggaaccagggctgcttctcatgagcaggtttctgtcctgctgtcactccatccctgtttgtggatggtggcattggtgctctgagatgatggcgttcgagactggggtcacagtgcctcccttttccgtggggcaccctggactcttttctggctgccgctctggcacaccccttttttgtggctggtctggtgctgggctccggcccggggagggagaggcccttcggtggtactcaccccatcccctccctctgctttccagacatctgcatctcctgtgggagcctcaatgttaccctggaacaccccctcttcgt

SEQ ID NO: 430288 - DNA, 235 bp, Homo sapiens
gctgtgcgcagggtgtgtgggtctaggagcctggctggagggccagcgctgggtgggagcttgggacaccgctgggcctgcatctgacctgttgtgctcactgcttaggaccctccaaaggtttacccacctgtcccagctgagaagaggaagcccatccgggtgctgtctctctttgatggaatcgctacaggtgaggggtgcaggcccaagaggtgctggccgccttgtccca

SEQ ID NO: 430289 - DNA, 216 bp, Homo sapiens
ccctctctgccttttctcccccagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaaca

SEQ ID NO: 430290 - DNA, 2224 bp, Homo sapiens
gagaaggaagagacagaggatttcaaggagagggaataagccctccaagttacaactgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 430291 - DNA, 3256 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 430292 - DNA, 2056 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcaccaaagtgagactattactatcgagtcttattccatcgccatctaaatactcctg

SEQ ID NO: 430293 - DNA, 2063 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacggaggtcaaatccatcgcaaaggtaacctctagggtagca

SEQ ID NO: 430294 - DNA, 2262 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgaggtacaaaatagccacctgtactagtgggctagtggccactgaattgaacagtgtagaggacaacccaccatcgcagaagttcatttggacaatgctgatctagaacgttccagtgacagcttgtggaatgtggctaggtgtaattccagcttctcctggaggctgcaggctagcccagtgtgtggctcctgagagagaatccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacggaggtcaaatccatcgcaaaggtaacctctagggtagca

SEQ ID NO: 430295 - DNA, 1917 bp, Homo sapiens
ccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacggaggtcaaatccatcgcaaaggtaacctctagggtagca

SEQ ID NO: 430296 - DNA, 439 bp, Homo sapiens
cttccgggttccagcaattctcctgcctcagcctcccgagtagctggaattacaggtgcctgtcacatacccgactaattttttgttatttttagtagagacgggatttcactatgttggtcagactggtctccaactcctgaccttggcctcccgaagtgttgagattataggtgtgagccaccacacccagccctggaggaatattctttacctgttatgaggttaacactttatttgtatcagttattattattagatctagcctgaaaacccatagccctaaattggaacaggcatgcctgtttttgcacccaaaagttgccttttggcccgccaagcccccctcttcctataccaatataaacctgaaaccgcaggccccacaagcagacgaggagatgaagaacagaatgacagaatggcttggcagagagaa

SEQ ID NO: 430297 - DNA, 3495 bp, Homo sapiens
gtggtgggctacaccagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataaggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430298 - DNA, 2129 bp, Homo sapiens
gtggtgggctacaccagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgag

SEQ ID NO: 430299 - DNA, 309 bp, Homo sapiens
gcacgagcaaatctaaatagatacttttgatttgggtagtaaaaccaaaggggatcagaagtgtagcagtgtgggtcctccctccctgcatagctgttaccaggaggcagcgtgcctgaagtacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430300 - DNA, 611 bp, Homo sapiens
taagagttgtgggtgagtatttttcaatatttaaataggtgtagttgaagtaagatgaactaataatgatggcacttttacagaagagaagaattgcttgaacctaggaggtggaggttgcagtgagccaagatcatgccactacactccagcccgtgcgacagagtgagacaccatctcaatataaaaagagaaatgataaatacatgtcattttaaattttaaagtagaattttttgggggggtagcaaataactatttgttgcagtgttatgattctgatttctttcgattcttaggaaagtggagaatgaggacatgaataaagaccagatcttgctggaaaaagaagctgaggtaagtaggaaagtactattggttggttggttggttggttgttttgtttgttttgagacagagttttgcactccagcctaggagacagagtgagactctgtcttaagaaaatttatcatattgtcttatctttctttggttattgtttctgtttggcttgcatattcgtatcatttacttgattttctctttagctgttgctttttttattgattggtaaaaagtctttatgtaataactcctcactattttgg

SEQ ID NO: 430301 - DNA, 2495 bp, Homo sapiens
tgcctgtaatgccagttacccaggaggctaaggtgggagaattgcttgaacctaggaggtggaggttgcagtgagccaagatcatgccactacactccagcccgtgcgacagagtgagacaccatctcaatataaaaagagaaatgataaatacatgtcattttaaattttaaagtagaattttttgggggggtagcaaataactatttgttgcagtgttatgattctgatttctttcgattcttaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430302 - DNA, 3198 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430303 - DNA, 2200 bp, Homo sapiens
acaaaatactagcaaacagaatccaacagcatattaagaaaattaaggccaggcacatggctcacgcttgtaatcccagcactttgggaggcggaggcgggtggatcacgaggtcaggagtttgagaccagcctgaccaatgtggtgaaaccccgtctctactgaaaatacaaaaatcagctgggcgtggtggtgtgtgcctgtaatttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430304 - DNA, 2072 bp, Homo sapiens
acccactactggcagccccaaatctgcacctcccgcggctgcggggctcctgcgtctcccgttccagctctgactcagcacaggaagccccgcagcccattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430305 - DNA, 3285 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattacaacaacacaaaagacttataaaataacggggt

SEQ ID NO: 430306 - DNA, 3576 bp, Homo sapiens
  misc_feature (8)..(8): n is a, c, g, or t
  misc_feature (3576)..(3576): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattaaaaacagtaaacaatggaaggtaacaactacgacaagaccaaaacaggctgaggagccaaccggcacacgcctgacagacagcaacgaaaccatacgcgaagaccctaacgaaaaaaaaaaccacaggactcggggggggtgaataacaaaccagggcgcggcccacacccagcaacatcagagagcagcaacccagaagcaaaaacacgaggcggggcaaacacgcagagaacgacgtggtacgagaccccccgggggagcgtgacccaccaaacgcgggaaactctggctagcacacccggcggagcgttaaaaagagcagn

SEQ ID NO: 430307 - DNA, 3215 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcgtccacgcagcgtgccactac

SEQ ID NO: 430308 - DNA, 1480 bp, Homo sapiens
gaggaaggacccagagtgacttgctggagccttagtcaccaaacgctcttgcagcttagtgggaaaggtgttcattgtaaaatacggtatttacacaaaatgcacaaaaatacgtatgtacagtttaataagttactgtaaggaaaacatccatgtcacccccaactgagtccaagttggttgctttagtttcatcatcacagtgacaccttagaatagtcctgagggtatgtgcttagttcacactttactgatgaggaaattgttgccgctccgagagtttaaaagtatttgctgatggtgccatgacttttaaacgatggcctgctgactctagaggctggtcctgcataaccagttaatggcatgtgactggggaagtgagggtacagtggaaagagacaaggatgcctcagcgatgcagctcatttgaagcaggaagcagtgacaggtgtttgcttattttctctgagcttcattttcaactgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430309 - DNA, 3239 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgggtacacgcattttcctcagctaaaacgtcgcccagtgaacccgtcttcatgctcatagccgtttc

SEQ ID NO: 430310 - DNA, 837 bp, Homo sapiens
acctcagatcgtcgatgcgcttcacgcgcttctcgaccggctgcaggcgctgataggcacccgcttcgtcgaccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430311 - DNA, 827 bp, Homo sapiens
gcggccgctccaacatcagaatggtaacactaaggctacagtgcacagaaaacagaccaggtgtggcttcgactgtgcggacctgcccactagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430312 - DNA, 2381 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtaaactgattgggatcctctagacgac

SEQ ID NO: 430313 - DNA, 2105 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaattttttaattgtctttttctctttttcttaatcaactaggttgtatcgagctac

SEQ ID NO: 430314 - DNA, 1810 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgag

SEQ ID NO: 430315 - DNA, 199 bp, Homo sapiens
tgccttttgctcagtttatgacctttgttaaggagaaaagtagaactgttaataattaacgcagcagacattgcctcactcccacttaagtgtgttttgttttcttttttctagaaaacactttcctggataaaaaagaaaacattccagatgcatgatccagctgtgtgttttcaatccttgggagggtgccatccac

SEQ ID NO: 430316 - DNA, 3252 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430317 - DNA, 3153 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430318 - DNA, 2918 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcgaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430319 - DNA, 3286 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattactgtttgtggaggtagcactactgtttgtggagg

SEQ ID NO: 430320 - DNA, 1249 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430321 - DNA, 3192 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctgactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430322 - DNA, 2483 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgagtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatta

SEQ ID NO: 430323 - DNA, 2013 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtatgcatccgcctgacaggggtcctctaggcgcctcg

SEQ ID NO: 430324 - DNA, 1525 bp, Homo sapiens
  misc_feature (8)..(8): n is a, c, g, or t
cgcgacgntgggcgggtccgcggcgcggtcggtcggcgcctattctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtttccttgcttttatgtttgtacacaacacctaaaaccagttttgctgctataattctatactgttgattcgtctgcgattttatctgttaaccaaataaaacataatagaatttcctaatgag

SEQ ID NO: 430325 - DNA, 436 bp, Homo sapiens
aaaaaaaaaaagtaaaacttaaaaagaaaaccttttaaaaatgaaaagtagggccaggcatggtggctcgtgcctgtcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaacataaggagaccttgtctctaaaaaaaaattaaaaaatcagacatgtggcacatgcctatagtcccagcttctctggaggctcaggctggaggattgcttgaccccaggaacttgaggttgcagtgagctatgatggcatcactgcactccagcctgggtgacagagcaagatcctgtctataaaccaca

SEQ ID NO: 430326 - DNA, 4483 bp, Homo sapiens
tcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttaaaaaaaaaa

SEQ ID NO: 430327 - DNA, 4429 bp, Homo sapiens
tcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattattcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttaaaaaaaaaa

SEQ ID NO: 430328 - DNA, 4427 bp, Homo sapiens
tcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaaaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttaaaaaaaaaa

SEQ ID NO: 430329 - DNA, 4429 bp, Homo sapiens
tcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttaaaaaaaaaa

SEQ ID NO: 430330 - DNA, 4429 bp, Homo sapiens
tcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaactctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttaaaaaaaaaa

SEQ ID NO: 430331 - DNA, 3463 bp, Homo sapiens
agaatcttgatagcaacattcgttaaggcgcgcgggcaccagactatggtcatagtcgcaacgatggctctattagctcgcttctcacgaggtagcatccatagggtctacttggacatagatgccttgcgtagttctcaccgaatgataatagaattgcccgcgtgggacaatcggtagcagttctgaacgcaatcactggtatgagagtttcgggagtgtcataacatgtgagtcttattcatactaggtgaagatcactagaagactggagactgcgcattatacataatataccgtgcccggtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttaaaaaaaaaa

SEQ ID NO: 430332 - DNA, 1459 bp, Homo sapiens
gctgtgccccatgggacacatagtggcggatggtatgataccttctaaattcacccttgatcagtggagacatcgagagcagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttaaaaaaaaaa

SEQ ID NO: 430333 - DNA, 3942 bp, Homo sapiens
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430334 - DNA, 3891 bp, Homo sapiens
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430335 - DNA, 3707 bp, Homo sapiens
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcacacgaaacaacacaacaacacaccccagaggacatcctagcagaggttgcaaaaaag

SEQ ID NO: 430336 - DNA, 3671 bp, Homo sapiens
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaagacacccacagcacacaccctg

SEQ ID NO: 430337 - DNA, 2166 bp, Homo sapiens
  misc_feature (22)..(23): n is a, c, g, or t
  misc_feature (28)..(28): n is a, c, g, or t
aacttaggctaggtacgaggcnnggtgntgatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430338 - DNA, 3696 bp, Homo sapiens
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430339 - DNA, 1064 bp, Homo sapiens
gcgttgcggcggccccaggagcccggcgggtggtgcagactaggcctccccggaccactcgggcgggcaggggccgggcggatgcaggggtgggcgggggcgagaggttcgcagactggctgaggccggcgtgactccgtgggcttgcctagcactaccgcggctgtggccgggccgagccgcaggtcttgcctcgcctcctactccgctgccgccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430340 - DNA, 937 bp, Homo sapiens
ccgctctccacccacccccgctctccacccacccccatcaacactatacaggcttcagaatggagactataccaggccgctctccaaacaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430341 - DNA, 1277 bp, Homo sapiens
cccttactttgtagccccatcctgcacctcccacaccataaccttcagtggcttcttcttccttctgcgttaatcccaaactcctctgtctggcattcaagtccttcatgttctgagtttgtaaccagagagggtcttcggccccttagcacaggaccagacttataattagtgacatggatatttgttgaataagtggctgaataaatgaattttacttctctaacctgacctctctcttcacccctctatccagagccacacttatgctcacttttaaatgcatttttgcacacactatccctccttcctagaatgtccacctctctccaggtcatggtgtcacctaaaggaagccctctctgactgcgccatccttctgtgattgtctctcccccgccagcctttccctggcatcaagtacacactaactaccctaacatgggagttgtggttcctgaaaaacagggggcagcctcctctttttgccccccactgtctgcctcaggttgtgcagggccaggtactatctccaccaagcagcaggggcctggagttgggatccctgcctcagtccttctaggagcaagtggtttcacagtggaggcccagcccaggctgccctgagtagtaagacagggtggcctcaggggcaggacacagcttccttcccatgttctcctgcagagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacaggtgtgtatgggggcttgggggtagctgggcagcccaaaggaacctgtatagcacaagtgggctgtacaggccacacctgctatattgtcagaattgggatattcttcagccagaatctctccaagggtgaattctccagggatgggaatttttttacaccagggactgggggttgaagagaggtggcagagagaggaaaggggggcctgcgctgtctgctgtcatcctgggacaactgatccaatggttgtccctaattggcctgtgatgttgtctctggacagcagaatatgatgcttaatgccccatcccctcaggaaggagccctactccctggaaaacacctggctagacttggactttgggaatatcctacaagtcagggtgatttgagtctacaaaaaaa

SEQ ID NO: 430342 - DNA, 1063 bp, Homo sapiens
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacaggtgtgtatgggggcttgggggtagctgggcagcccaaaggaacctgtatagcacaagtgggctgtacaggccacacctgctatattgtcagaattgggatattcttcagccagaatctctccaagggtgaattctccagggatgggaatttttttacaccagggactgggggttgaagagaggtggcagagagaggaaaggggggcctgcgctgtctgctgtcatcctgggacaactgatccaatggttgtccctaattggcctgtgatgttgtctctggacagcagaatatgatgcttaatgccccatcccctcaggaaggagccctactccctggaaaacacctggctagacttggactttgggaatatcctacaagtcagggtgatttgagtctacaaaaaaa

SEQ ID NO: 430343 - DNA, 1137 bp, Homo sapiens
cccttactttgtagccccatcctgcacctcccacaccataaccttcagtggcttcttcttccttctgcgttaatcccaaactcctctgtctggcattcaagtccttcatgttctgagtttgtaaccagagagggtcttcggccccttagcacaggaccagacttataattagtgacatggatatttgttgaataagtggctgaataaatgaattttacttctctaacctgacctctctcttcacccctctatccagagccacacttatgctcacttttaaatgcatttttgcacacactatccctccttcctagaatgtccacctctctccaggtcatggtgtcacctaaaggaagccctctctgactgcgccatccttctgtgattgtctctcccccgccagcctttccctggcatcaagtacacactaactaccctaacatgggagttgtggttcctgaaaaacagggggcagcctcctctttttgccccccactgtctgcctcaggttgtgcagggccaggtactatctccaccaagcagcaggggcctggagttgggatccctgcctcagtccttctaggagcaagtggtttcacagtggaggcccagcccaggctgccctgagtagtaagacagggtggcctcaggggcaggacacagcttccttcccatgttctcctgcagagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacaggtgtgtatgggggcttgggggtagctgggcagcccaaaggaacctgtatagcacaagtgggctgtacaggccacacctgctatattgtcagaattgggatattcttcagccagaatctctccaagggtgaattctccagggatgggaatttttttacaccagggactgggggttgaagagaggtgccgatgaatagcgaattcaacacaccacaatactatgaacggccatgcaccaccacccacggaggtgccgatgaatagcga

SEQ ID NO: 430344 - DNA, 523 bp, Homo sapiens
gcggccgcgcccggcccctggcccgctcgcccgccggcaccatgatggaggagatcgaccggttccaggtgcccaccgcgcactcggagatgcagccgctggtgagggggcgggcggcgggcaggccaaggccggagggggcgtcgcttgagggggagggagggaatcaggccggggggatcgtgcggaggggcgccatcggatggggcaaagagatccctgaaaacgtattgccgggggacggggacttgcaggacaagaaaaccgtgggagaatatgctggatgagagcaaagggacctgtaagggcggagggcaccgtcggtggaagcagggcaccgtcggatggaacggagggggcacaaaggtgcacaccgctagtggaggcccatagcagggactggcgagggaactgccatggggcaccgccggcggcaggcccaggggtctgggatgggaggtggggaggcgtttagtcctagaggcctgtgatgcttagggcgggggagccgtcaggctaagag

SEQ ID NO: 430345 - DNA, 788 bp, Homo sapiens
  misc_feature (581)..(582): n is a, c, g, or t
  misc_feature (590)..(590): n is a, c, g, or t
  misc_feature (602)..(602): n is a, c, g, or t
  misc_feature (611)..(611): n is a, c, g, or t
  misc_feature (617)..(617): n is a, c, g, or t
  misc_feature (629)..(629): n is a, c, g, or t
  misc_feature (632)..(632): n is a, c, g, or t
  misc_feature (634)..(634): n is a, c, g, or t
  misc_feature (639)..(639): n is a, c, g, or t
  misc_feature (645)..(645): n is a, c, g, or t
  misc_feature (654)..(654): n is a, c, g, or t
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatnnactttganatgtctagatantcctcctcnggatantcctctgctgancanantcaancaaganttgaacatncagactgctagagggacggctaccgggttacgatcaagaatccccgagaacgaggaccatagacttataccgccaagtcagaaacccacggccattgtgccaggaagatcaccacgcatgaaatcaataagacg

SEQ ID NO: 430346 - DNA, 4156 bp, Homo sapiens
cccttactttgtagccccatcctgcacctcccacaccataaccttcagtggcttcttcttccttctgcgttaatcccaaactcctctgtctggcattcaagtccttcatgttctgagtttgtaaccagagagggtcttcggccccttagcacaggaccagacttataattagtgacatggatatttgttgaataagtggctgaataaatgaattttacttctctaacctgacctctctcttcacccctctatccagagccacacttatgctcacttttaaatgcatttttgcacacactatccctccttcctagaatgtccacctctctccaggtcatggtgtcacctaaaggaagccctctctgactgcgccatccttctgtgattgtctctcccccgccagcctttccctggcatcaagtacacactaactaccctaacatgggagttgtggttcctgaaaaacagggggcagcctcctctttttgccccccactgtctgcctcaggttgtgcagggccaggtactatctccaccaagcagcaggggcctggagttgggatccctgcctcagtccttctaggagcaagtggtttcacagtggaggcccagcccaggctgccctgagtagtaagacagggtggcctcaggggcaggacacagcttccttcccatgttctcctgcagagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430347 - DNA, 3909 bp, Homo sapiens
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430348 - DNA, 3890 bp, Homo sapiens
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430349 - DNA, 2032 bp, Homo sapiens
agcgggagtcagccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaaaaaaaaaaaaaaaaaaaaaaaaaaaaaaaagagtaaaaaaaaggggggggggcgccaaaaaaaaacccccggagggggccaaaggtatgccgcacccaccttttgtgtaacagggcggcccaaaaagggagacgaaaaaaaaaagaagaggagggggcgggcgaaacacacaggcgagtggggacaggggtgcgggggactgtggaagaccctcgcgggggggcgccaggggccacacccaagaaataacgcccgcgcataaactgcggcgacgggggaccaggctatttccgg

SEQ ID NO: 430350 - DNA, 4421 bp, Homo sapiens
  misc_feature (3977)..(3977): n is a, c, g, or t
  misc_feature (3979)..(3979): n is a, c, g, or t
  misc_feature (3982)..(3982): n is a, c, g, or t
  misc_feature (3984)..(3985): n is a, c, g, or t
cgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatctcttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggcataaaatagaataattcttttctgaggatagtagttaaataactgtgtggcagttaattggatgttcactgccagttgtcttatgtgaaaaattaactttttgtgtggcaattagtgtgacagtttccaaattgccctatgctgtgctccatatttgatttctaattgtaagtgaaattaagcattttgaaacaaagtactctttaacatacaagaaaatgtatccaaggaaacattttatcaataaaaattacctttaattttaatgctgtttctaagaaaatgtagttagctccataaagtacaaatgaagaaagtcaaaaattatttgctatggcaggataagaaagcctaaaattgagtttgtggactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaaccaaatgagatgataggatagatcctggttaccactcttttactgtgcacatatgggcncngantnntttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcatttt

SEQ ID NO: 430351 - DNA, 1055 bp, Homo sapiens
cgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgagactttgatcctggctttctctttaatgaatcatttgtaaagactttgattcttcagacactcttgggctctctgacgtctcctatttggagtcaacaagcaggttaattcccatgtatcatttaaatgatcagcttatatgaagggtatagtaagattttataatctttggagactagttggctagaaggtcaaattaagtgcccgtcaacctagatttttagttaatgacttactgatctggttttgtcagcataaacacaatgtgttctttcattttgggacccttcccataatattcctcaagcttaagtctcactttgctcttagtaataaatcagggttattcccttcctgctttctgacaggttaattctaaagaagagctcctgggaataagaaaatagaaacaattcgaggttgtggattgttgcaataaattctgggattt

SEQ ID NO: 430352 - DNA, 612 bp, Homo sapiens
  misc_feature (523)..(523): n is a, c, g, or t
  misc_feature (593)..(593): n is a, c, g, or t
cgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaaatctgcagggacctgtgcctgggcttagggcctctggagcactaccgtcacctgtcatagcagttccaggaccagcttgacacagagcaccatggccaacaacacgttctctgtgactcccgaggccactgcttgagctatctcaggtccgccagaagcctgcctaccactatgaactttcgagaacacacgtatacaattcttctctgaaccgaacaagtgcctggcaatgaggacagacctcagtgnaggtttggaaaggggaagccaacagtttgaacacagctttcccaccttcctttaaatcctgacactccgngactttatttgaatacctg

SEQ ID NO: 430353 - DNA, 1479 bp, Homo sapiens
  misc_feature (1441)..(1441): n is a, c, g, or t
cgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctcttttatggttctttcttgctgtcagaagtcacaaaggagttgaacttccctttggccactgcctggcaataattgaaagtgggaagagatctgtatgctctacttcattcatttttaggtgaacattagaagcccctcttcatttaaaaatattcacctccgcttttattcaaactttgctgcccgaaaggggcgntgtttttccacagtctcatagccgggaggtgcttaatt

SEQ ID NO: 430354 - DNA, 1388 bp, Homo sapiens
cgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctagttcagcatgactggggaggcctcaggaaacttaacgatcatggaggaaagcaaggcaccttcttcacaaggtggcaggaaggagaagtgtagattacacctactctggtggtttagtgaatataagtaagtaaattgccgta

SEQ ID NO: 430355 - DNA, 1058 bp, Homo sapiens
  misc_feature (1020)..(1020): n is a, c, g, or t
tgaaagggagaaagatttatttgaactatttcaagaaaatagttctcagaaattcttcagttacataaaggacacttattcagcacgttaatattcaaagttaacaaaatatataacagaggtatgtgttagaaattatataaggtaatacataaaaaagtattataatgaaatattgcaaaccgttaacacagatcataaggatcacttttttcttctagcaaaaggaaaattatgctgagttaaagatagatagcacaattttgatgaagagagttttaattgattgattccagtctgttatgacctaaacttctcaaaatgtgttgtaggaatcctagaagaaaaaagaaactaaagatactgactatgaaattacatatatgagcatatttttaaaatgggaataaaactgtctttcaatgaagcagaataatttgatagtgacacttcatcctggaaaactgcaagatgcaattttacactgctttgagtacaagtatcttttgagctgtcatgcagaaatggtttctctacttgaaaatggggttttcctttcatcattcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctagttcagcatgactggggaggcctcaggaaacttaacgatcatggaggaaagcaaggcaccttcttcacaaggtggcaggaaggagaagtgcttttatggttctttcttgctgtcagaagtcacaaaggagttgaacttccctttggccactgcctggcaataattgaaagtgggaagagatctgtatgctctacttcattcatttttaggtgaacattagaagcccctcttcatttaaaaatattcacctccgcttttattcaaactttgctgcccgaaaggggcgntgtttttccacagtctcatagccgggaggtgcttaatt

SEQ ID NO: 430356 - DNA, 679 bp, Homo sapiens
cgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtatgtatgatatacacgtgacatccccccactaccatcaccatgcacaaatatcttaaaataactttaatcct

SEQ ID NO: 430357 - DNA, 702 bp, Homo sapiens
cgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagatggagtcttgctctgttgccagactggagtgcagtggcacaatctcggctcactgaaacctcctcctcccgggttcaagccattctcctgcctcagcctcctgagtagctgagactacaggcgtgtgccaccatgcccggctaattttttgtattttagtaaagacgaggtttcaccgtgttagctaggatggtctccatctcctgacctcatgatccacctgcctcggcctcccaaagtgctgggattacagctccc

SEQ ID NO: 430358 - DNA, 4367 bp, Homo sapiens
  misc_feature (3923)..(3923): n is a, c, g, or t
  misc_feature (3925)..(3925): n is a, c, g, or t
  misc_feature (3928)..(3928): n is a, c, g, or t
  misc_feature (3930)..(3931): n is a, c, g, or t
cgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattgggatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatctcttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggcataaaatagaataattcttttctgaggatagtagttaaataactgtgtggcagttaattggatgttcactgccagttgtcttatgtgaaaaattaactttttgtgtggcaattagtgtgacagtttccaaattgccctatgctgtgctccatatttgatttctaattgtaagtgaaattaagcattttgaaacaaagtactctttaacatacaagaaaatgtatccaaggaaacattttatcaataaaaattacctttaattttaatgctgtttctaagaaaatgtagttagctccataaagtacaaatgaagaaagtcaaaaattatttgctatggcaggataagaaagcctaaaattgagtttgtggactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaaccaaatgagatgataggatagatcctggttaccactcttttactgtgcacatatgggcncngantnntttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcatttt

SEQ ID NO: 430359 - DNA, 2847 bp, Homo sapiens
gtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagta

SEQ ID NO: 430360 - DNA, 3108 bp, Homo sapiens
gtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcagtaagtacttcatttttaataaagggaagaaatttgtaaagttgtagaaataagtaatatacaaatgtcttctacttttcactttggagttaaatttacatatatctatattacatagatctataagggtattggttggcctgtgcctcctgtttgaagaagataggaattaattgagaaggatttggactatttggttggtttaatgtggaatagggcaggttattgagttaccatcattaaaagaaatgttttgtatagcttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagta

SEQ ID NO: 430361 - DNA, 995 bp, Homo sapiens
  misc_feature (6)..(6): n is a, c, g, or t
  misc_feature (11)..(11): n is a, c, g, or t
tagaanatggntcccgggctgcagattcggcagagcatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagta

SEQ ID NO: 430362 - DNA, 2055 bp, Homo sapiens
gtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttctta

SEQ ID NO: 430363 - DNA, 2625 bp, Homo sapiens
gtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaagggtgagtaaatcatttgttctactcttaaccactatgccatactgcttcccagtagtacttcactatttttgtttataaaaatgttgtgacccacctgggcaatgtggtgagatcccatctctagcaaaataaaaataaaaattagccaggcatgttggtgtgcacctgtagtcccagtgacttgggaggctgatgcaggaggatcgcttgaacccaggagtttgaggctgcagtgaactgtgatttcaccagtgcactccagcctgggggtgacagagtgagacactatctctaaaaaaaaaaaagtgatgatttatgcatttattaactcagaatcccctttgtttccaaggggctttttctttctttctttctttttctttcttctttgagacggagttttgctcttattgcccaggctggagtgtaatggtgtgattttggctcactgcagcctctgcctcccggttcaagctattctcctgcctcagcctcctgagtagctggattacaggcatgcaccaccacgcctggctaagtttgtatatccaaggggctttttctatgaaataattaggaccctggttgggaggcataaatagttgtggtactgaaataggacagaaagtttttcagctcacatacacagaaaacttcttagtaaagctttttgaggctgaatgatgaagcatattgtattttctttatttgacatcactgcaaaatggaatggtgaagagttttgccgaataaatcatagaaaaatctttagaaatgttagccactagggaggccaggcatggtggctcacgcctgtaatcccagcactttgggagaccaaggcgggcggatcacgaggtcaggagatcgagaccatcctggctaacacggtgaaaccccgtctctactaaatatacaaaaaactagctgggtgtggtggcgggcgcctgtagtcccagctactcgggaggctgaggcaggagaatggcgtgaacccaggaggcagagcttgcagtgagccgagattgcgccactgcactccagcctgggcgacagagtgagactccgtctcaaaaaaaaaaaaaaaaagaaaagaaa

SEQ ID NO: 430364 - DNA, 1636 bp, Homo sapiens
gtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggttactattaagcagtttaaggatagaatatcgcgagtacatcattaagtttagctgcagaagatatgatgacttatcgatgagctaatgtacggacacgcttccttgagaggactctgcggaggaccgag

SEQ ID NO: 430365 - DNA, 519 bp, Homo sapiens
gggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagtataatgtgtgtttttagatattttgtgtaaaaattaagaatctaaattttttatcggtaactcttctagttatttcctttggaatctagttttatgttcaataatagaaacttgaaatctttatcaaaaatcacaaggacccaaattcatgtatttgtccctaaagtaaggtgagtgatgatggtttctctaaacctttccagtgttttaatttgttaattt

SEQ ID NO: 430366 - DNA, 2202 bp, Homo sapiens
cttcatatctcatttaaacacacaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagta

SEQ ID NO: 430367 - DNA, 3054 bp, Homo sapiens
gtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcagtaagtacttcatttttaataaagggaagaaatttgtaaagttgtagaaataagtaatatacaaatgtcttctacttttcactttggagttaaatttacatatatctatattacatagatctataagggtattggttggcctgtgcctcctgtttgaagaagataggaattaattgagaaggatttggactatttggttggtttaatgtggaatagggcaggttattgagttaccatcatttttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagta

SEQ ID NO: 430368 - DNA, 2050 bp, Homo sapiens
gtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggcggaggttgtggtgggccgagatcacaccattgcagtctggcctgggcgacaagagcaagactccgtctcaaaaaaaaaaaattgttcttgctttgtaaatgctgctttcttttcttcattttggagcggggagccttgccgatagtcagtgacttgtacatttgtttactggcatttgataggctgctccttatcttgcatgaaaaaataaagacctagccagtctaatcctgctgggattcatatcagtggccccagggggttgagatgcttcaaagctactgtttaaatggcaaaaccaagtatcttacttggataatactaaagtatgtcctttatggctttattggaatctgaattgtaaacatttggtacagtgg

SEQ ID NO: 430369 - DNA, 1700 bp, Homo sapiens
agcggcgcgcgaggcccccgccgtcgccgacgcccgagcgccggagccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagcaaaaaaacaacaccacctgcccacacaggacccacaaccaccaacaggggccgctcgaaaaaccacgggcgcacaaaaccacc

SEQ ID NO: 430370 - DNA, 1790 bp, Homo sapiens
gctaggtcggctttaaaatcgatgcagagtaattgcagtacatgggtagttggatgacattaacatgagaaatgtgctgtagtcgtcatccttggaacaaacacgtccaattacagtgaaattctgtgccccttacccggctaatttgaacacagctcaccgccaaggcctcctccagcatggccagccctgggcagagatcgtcacgaatggatttgacgggaatggggctggggactgtcatgttgaagcccggtggagatgtgggacagggacctcgtttgttccagagcctgttccaaccctccctggcttttgtggcatgttttctatgccgtttgctgcaaggatgcgttgggcatggagtaacattcccgagaccgtcctgcagtactgcacgtgtgcgtgtctgtgctttggtttgtctgtgtgtctaccttgttttagagtaaaaaagtgaatctgaggccagatcatcagtctgcacctgcctctcctcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatggcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430371 - DNA, 384 bp, Homo sapiens
ctcctcctcctccgcattctctcctctgatgaaaccacactcatcaaaagtggttgtgacagaatgctcagatttgaatgatgatatttcttccctaaaacaaaattaaatttttctgttagactttttgagaaaattatagtagttgtatttttaaaattttttctaaattgaaaaatagaaatgtgaaggcaatttaatagactgtttttaattattaaagttttataattctaaatgaaatatttgttttaggttcagttccggaaggtgtcttagaggacattaaaggtaaactaagttctcatttttgtccctttcatccttaagtgttactttggagggcatatgcttctaaacatttacacagatagaaaatatatt

SEQ ID NO: 430372 - DNA, 1536 bp, Homo sapiens
agcggcgcgcgaggcccccgccgtcgccgacgcccgagcgccggagccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430373 - DNA, 1671 bp, Homo sapiens
ctccccttttcttcaaccagcgcccttgcaaataacagctcttattatttcctccctgggcgatgcgaatccgaggatcggggtctgactcccagagaggcccagaaagcttctgttgaattgccctcgtcgccgccccttgtcatcaccccaaacccaacaaaccctttgggatcatctgtgtaggggatgacaaccgtgacctagaccccgcttaccctgggctcctcagttgaggaaggcagccaaccgaatgtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430374 - DNA, 1826 bp, Homo sapiens
gctaggtcggctttaaaatcgatgcagagtaattgcagtacatgggtagttggatgacattaacatgagaaatgtgctgtagtcgtcatccttggaacaaacacgtccaattacagtgaaattctgtgccccttacccggctaatttgaacacagctcaccgccaaggcctcctccagcatggccagccctgggcagagatcgtcacgaatggatttgacgggaatggggctggggactgtcatgttgaagcccggtggagatgtgggacagggacctcgtttgttccagagcctgttccaaccctccctggcttttgtggcatgttttctatgccgtttgctgcaaggatgcgttgggcatggagtaacattcccgagaccgtcctgcagtactgcacgtgtgcgtgtctgtgctttggtttgtctgtgtgtctaccttgttttagagtaaaaaagtgaatctgaggccagatcatcagtctgcacctgcctctcctcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430375 - DNA, 1396 bp, Homo sapiens
atatgatgtctaatgtgaatctaagagcggccctgcctccaaatctgtcgcgtataggtacaggtatatcattcgttcacacctgcaatcatattgttatctaaaaatgaaatgcattgaggatgctatcttgcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430376 - DNA, 1196 bp, Homo sapiens
gtccgcatatagtaaatgcgttaactaggctttaaatgacgcaattctccctgcgtcatggatttcaaggtcttttaatcacctccggtttaatctctttttaaaagatcgccttcaaattattttaatcacctacaacttttaaactaaactttaagctgtttaagtcaccttcattttaatctaaaagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430377 - DNA, 1342 bp, Homo sapiens
agcggcgcgcgaggcccccgccgtcgccgacgcccgagcgccggagccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430378 - DNA, 1070 bp, Homo sapiens
agtttataaaatccaaaggaatagatgatgagcatgttcacttgaatagaattgttttaactggggtgtaggtacactctgttcaattataataactagccataataaggtctccttttcttccttaaagcgcgtacttgctttgtaagtgatctgaagcgaggactaaaaatccaagcagcaaaatttaatattgatgggaataatgaggtaagtttaaaaaaaaaaaaggcatctttttgcaaaggttacaacatgtgtggacttatgtttatgatatttatatttcagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430379 - DNA, 915 bp, Homo sapiens
agcggcgcgcgaggcccccgccgtcgccgacgcccgagcgccggagccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccacaactgaatctctgattgatccaaggatatgtaaaatcttctctccatctaatgtcgacg

SEQ ID NO: 430380 - DNA, 788 bp, Homo sapiens
cggtatccgaagctaggactaataaaccacggcttgaacttttagattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgctatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430381 - DNA, 716 bp, Homo sapiens
gggtggcagagccccaggcactgcctgggtcctcatcgccgactcgctgggcagctccgggcctccccttttcttcaaccagcgcccttgcaaataacagctcttattatttcctccctgggcgatgcgaatccgaggatcggggtctgactcccagagaggcccagaaagcttctgttgaattgccctcgtcgccgccccttgtcatcaccccaaacccaacaaaccctttgggatcatctgtgtaggggatgacaaccgtgacctagaccccgcttaccctgggctcctcagttgaggaaggcagccaaccgaatgtaaatgctcgatgacgaatttcatcataaaatattgaacggagtttattttggtgctgaaaatggaaagatgtttaagacagggctatcgctgctcaagaattagggagactgggcacattaagaggtgaaaccctatagataagattctggaaatcctttgttggctcccctaaactcgaaggttagatttgacatgttttaaacaaaccaacttgtaaacaatagagaggaggttctcaacctttcggatggcatagatctctttaatggctggatgaaaaccacaaatgcacaaatcttaaggtacttatacacagtttcagggaattggcagacaatcaatgtggtcctgggaccctagattaagagtccttgtgatgggctcaacagagaggg

SEQ ID NO: 430382 - DNA, 1618 bp, Homo sapiens
agcggcgcgcgaggcccccgccgtcgccgacgcccgagcgccggagccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430383 - DNA, 839 bp, Homo sapiens
tggtggtggtggggtgtgagataatcagcgtgggggggttgcgtgccgaggcgccgcgtacttgctttgtaagtgatctgaagcgaggactaaaaatccaagcagcaaaatttaatattgatgggaataatgagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430384 - DNA, 1503 bp, Homo sapiens
ttcttattggctccccaaatacacaacaaggaggtcctgccgtggaagatgaagaactggagctgctatgtagaacaggagtcatttgtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430385 - DNA, 1564 bp, Homo sapiens
agcggcgcgcgaggcccccgccgtcgccgacgcccgagcgccggagccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgatagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430386 - DNA, 1573 bp, Homo sapiens
agcggcgcgcgaggcccccgccgtcgccgacgcccgagcgccggagccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaatgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430387 - DNA, 1369 bp, Homo sapiens
agcggcgcgcgaggcccccgccgtcgccgacgcccgagcgccggagccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaacctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgagagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430388 - DNA, 1231 bp, Homo sapiens
ctcctcctcctccgcattctctcctctgatgaaaccacactcatcaaaagtggttgtgacagaatgctcagatttgaatgatgatatttcttccctaaaacaaaattaaatttttctgttagactttttgagaaaattatagtagttgtatttttaaaattttttctaaattgaaaaatagaaatgtgaaggcaatttaatagactgtttttaattattaaagttttataattctaaatgaaatatttgttttaggttcagttccggaaggtgtcttagaggacattaaagcgcgtacttgctttgtaagtgatctgaagcgaggactaaaaatccaagcagcaaaatttaatattgatgggaataatgaggtaagtttaaaaaaaaaaaaggcatctttttgcaaaggttacaacatgtgtggacttatgtttatgatatttatatttcagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 430389 - DNA, 714 bp, Homo sapiens
agcggcgcgcgaggcccccgccgtcgccgacgcccgagcgccggagccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgagagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccgagggtaaggctcccgggggtcctctaggcagcc

SEQ ID NO: 430390 - DNA, 2096 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttggctcatattcacatatgtaaaccagaacatttctatgtactacaaacctggtttttaaaaaggaactatgttgctatgaattaaacttgtgtcgtgctgatagg

SEQ ID NO: 430391 - DNA, 2599 bp, Homo sapiens
agctggtacggtcccgaggtgctatggatgcctcttcgggcttctcctgctgacatctgccctggccggccagagacaggggactcaggcggaatccaacctgagtagtaaattccagttttccagcaacaaggaacagaacggtaggaactatatccaagcatctggactggcatagaaaagaggagaaagaacatttaaaaggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttggctcatattcacatatgtaaaccagaacatttctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaa

SEQ ID NO: 430392 - DNA, 2061 bp, Homo sapiens
ggattatgcagcatagaacaaaaggagagaaaaatgattaaagcaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttggctcatattcacatatgtaaaccagaacatttctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaa

SEQ ID NO: 430393 - DNA, 1975 bp, Homo sapiens
attcttgcccatctcatctgtgtgaaaaagtatccttttttccaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttggctcatattcacatatgtaaaccagaacatttctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaa

SEQ ID NO: 430394 - DNA, 1757 bp, Homo sapiens
ttttttttggtgggagagtgttttcataatgcgtgctctaggaaaaattaaaatatgtgtctttcttgggccccaagattcttttctaaaacgttacttgtttataaaagccagtcatagacattcgttgatttttaaaagtggcttactcttattccctttcaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttggctcatattcacatatgtaaaccagaacatttctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaa

SEQ ID NO: 430395 - DNA, 1222 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggtaggaactatatccaagcatctggactggcatagaaaagaggagaaagaacatttaaaaggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccagtaagtaccactttcagatccccttatttaattggatcagctttttgtttctttttatttttctcctcttacacatgagaatcagaaaaaaaatcagaaaacaaacctagctgggatttcatttttatgtaaataaaaactcttacatgccaagccagcaattcattaggcaaat

SEQ ID NO: 430396 - DNA, 483 bp, Homo sapiens
aagacccagaagatgacatatgcaagtaagtgatcatacttgaaatcccaacaatgtaacaactgttaaaagtctttcaaattgcttaattttgatgatctgattttaaatgacatcttttgttttatttttctgatgatctaagaaatttccagccttattgaagctatgttttatttgaagtcttcatttaaaatcggaagacacattgtgcatacaaagtcattgttttctacctacttctaaaattatttaatataatttatggtaaaaaagcatacatggaataaaaccatttaaaataaggattagagaatacaaagctgtataaaggactgtagttgtgctagaaaaccaaagttgcggttactgctaaaaatcttatatttgaccttcctcatagccaaatcaataaaataaatgataagctactgaaagaaaaagttctatccacaggtacatattacctggatacatacccat

SEQ ID NO: 430397 - DNA, 3004 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttggctcatattcacatatgtaaaccagaacatttctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaa

SEQ ID NO: 430398 - DNA, 3065 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggtaggaactatatccaagcatctggactggcatagaaaagaggagaaagaacatttaaaaggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttggctcatattcacatatgtaaaccagaacatttctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaa

SEQ ID NO: 430399 - DNA, 1658 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggtaggaactatatccaagcatctggactggcatagaaaagaggagaaagaacatttaaaaggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagaggagataattatgaaaaggaaaaaaatctgaagaccaacttttacaaatatttggcagagggaaacttctttaatattattatagttaagctattcaaaaagtatcctttggtacattatctttctttcttcttttcctttttctctttatttgccttccccccccaaaagtactatacaatgtttcaagaatgtatgacatatgacttaacttaatgaagcttatatgcgtttgaagccttagcagtaggcagcataaatttcaaaatgaaatgccaaatttaaaatccttagttatatttttagaaaactgtggactgcataaatgctttacttttttttctttcactttcttcctctagttcagggttttcattcataccttgctactgctacaaaaaaat

SEQ ID NO: 430400 - DNA, 1474 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccacc

SEQ ID NO: 430401 - DNA, 447 bp, Homo sapiens
gagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggtaggtggcttcca

SEQ ID NO: 430402 - DNA, 7470 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaatttcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430403 - DNA, 6965 bp, Homo sapiens
ggaggggaagcgaggaggcggggaaggggcgggccccaggagcaggcgggcggggctccccgccctccagcgcgcccggaggctaccactccctgcagatgcgctggccccagcccggggctgccgctcgccttcccccggagtctcctggacccccggagtctcctggacccccggagcgggaggcagcggcgcgcggcgctggactggagcagaaccccaggactgcgcccccgggagcgggcgcccagagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430404 - DNA, 6790 bp, Homo sapiens
agccagggtgcacgcaggaatctgtctggaaaaaggcagttctcactgaggaggtttgaggcgcgcgctctgggcaggaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430405 - DNA, 6796 bp, Homo sapiens
catactgggccgggttttagttgtaatcgtggtgcctggccgacaactcacatgaggaggtttgaggcgcgcgctctgggcaggaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430406 - DNA, 5090 bp, Homo sapiens
  misc_feature (9)..(9): n is a, c, g, or t
agctcggtncccatccttcctctctcacgaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430407 - DNA, 8003 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430408 - DNA, 4369 bp, Homo sapiens
caaccttatcccaatgctgtgtgaagaaaggaggtcattgaaggaggccctggcttaggcatgtcctctgggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430409 - DNA, 3848 bp, Homo sapiens
ggaagccccattcttgaggctagacgtctgccttctgaagacataacctctctttctggttccagatccactttatttcttactaggattagtgggactgggtcaaatctcttcactctgacaatttgatctctcattggcttgatatcctgaaaagactgttgattaaccaggctataaaccaggatgaaaccttggccgtttttgatgtagagatctctcatggaggcaaactgcttcagttcctgcggtgtccagaatttccagcacggagggggaagagtccacttcgatctctttgcggtagaaatcttcaatggtgggcacacattatggagctccataatgtgtgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430410 - DNA, 1643 bp, Homo sapiens
tctagagtagagcgaggccccacacaggcgggccgcacacacagcccggatcgcagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430411 - DNA, 1542 bp, Homo sapiens
tctagaggatcccggtcactttctacactctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430412 - DNA, 813 bp, Homo sapiens
  misc_feature (11)..(11): n is a, c, g, or t
tagaggattcnccggcagaataccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430413 - DNA, 556 bp, Homo sapiens
caagcaggatgttcccttgtactgagaggaaacgaaattgaaaatgcaagtctgagctcatttctttctggtgacttgtgggtcgcttcagatgtttgcaaccttatcccaatgctgtgtgaagaaaggaggtcattgaaggaggccctggcttaggcatgtcctctggtgagtgattttgttcggttcagtttggtttttaaatacgagtgggtgaaggctttttcttttattttgagaaatgtggaaacaaaggctctttgatttaagacctcagacttcatgcatagagagagtaataatcacccaaatcataatatctgaccaaaattttcaggacttttggaatccccattcctggctttttaaaagttagacctgaaatccagaaggaagatttggacagtcagggatgacaatagctgtattctgagtgcatgcagccttttctcgggttctttgggtgggaggaattgcagattcttttctctgcctcctgtcagcacggctcgccacagatgcccaagggaaatccatccggcctggaaaatccaga

SEQ ID NO: 430414 - DNA, 7525 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430415 - DNA, 8182 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430416 - DNA, 7976 bp, Homo sapiens
cgcggccagtgcactcggctccgggagaggcgagcagcgccggtgagccccgcagcagcgcacccggccgcggagccccgcgatggagatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430417 - DNA, 7107 bp, Homo sapiens
cagactttcctgctgtcagtgccttcaggggagggtggaacggcccactcggagtcccagctccttctccttcctgtcgtcgttagcagggagggccagaggaggtgcagccagcctgcttagaaactttggtgcaccgcgctttcttcaattctttttgcccggcacagtttgcgccgttgaagagggctggaagtttatttccagctattgctgcagcacttccttctcctagtgctgttcgttcttcttatgggaactggtactcactccctccaagtctgtgagcgtcttgctggggatggcggatcaccttggagctctgaggacctcgcacggcccaggctgagagcatatagctctgcagggtcccaggatatgcttatggatccaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430418 - DNA, 7418 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtagtgcattgatttgggtgtcttaccaatattttcttgtttctttgggggggggaaagcgcatctggttgcaattccggctgttcggttgtacctaagtttcgctggtaagaggaggcagagtacgcttcctaacaggggttttaaaaaagg

SEQ ID NO: 430419 - DNA, 4323 bp, Homo sapiens
gtaacatgctacaaaactgctccaggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaaaaaaag

SEQ ID NO: 430420 - DNA, 413 bp, Homo sapiens
tctggactatctcagccttttattttttctcagaagcacttttagtgtttctgcaagatctcacagtgtacacaggattcgttgccaaataaagcatcattatctcctcactaaatggcatgaagaatatataaattctggaaggacgcatgcctacagaaacaggaattagcagcaactcagaatacttcaacagtgatcctttgccttcaagactaagttaatagagaagatgtttgtaactctggcccaagcttggtctcccagtgtgctgaagctaactccttttagaagcaccactctcatatattaaaatacattgtttgtttgttgttaacttttctgggcttctggaatctaaacttttgcccaaaggctagaatgtgccattttataaaaatagttttcttctg

SEQ ID NO: 430421 - DNA, 5456 bp, Homo sapiens
agcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattggtggaatcacagtgtctgtggttgcattcttcttcacaattaagttcctctttgagcttgccgcacgtgtagtcagcttcctccagaatgaggaccgcgagcgccgaggggaccggactatttatgactacgtgcggggaaattacctggatccccggtcttgcaaagtctcctgggattggaaggacccctatgaggtgggccacagcatggccttccgagtgcatttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430422 - DNA, 555 bp, Homo sapiens
attaatccacaaagaagaactctgtaagctttttcttgaattgtagccagtgagaaaagcagatagactgaagaatatgaaggatagctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagaatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430423 - DNA, 244 bp, Homo sapiens
tcaaagacgctaaaaggccagaagggtagctggccccccaagtacctgggtcacaaggacataaataaaagaattggccaaaatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430424 - DNA, 254 bp, Homo sapiens
agcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcggagatgggatctcactatgttacccagattggtcttgaactcctgggcgcaagccatcctcccacctcagcctc

SEQ ID NO: 430425 - DNA, 5380 bp, Homo sapiens
agcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattgttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatagggtctcactatgttgcccagggtggtctcgaactcctggactcaagtaatcttcctgctttggccttccaaagtgttgggattacaggcgtgagccaagtcacacagcctgattactgtagctcttataataagtcttgaaattggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430426 - DNA, 5187 bp, Homo sapiens
agcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattgttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430427 - DNA, 2946 bp, Homo sapiens
gagtaaacacctgccaacccctgtactcccctttgctccatcagttatcaggaaggagaactaaggagggaggaagcttattaggttcactgttgaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430428 - DNA, 2944 bp, Homo sapiens
catagtaacaccttaccatctttttccagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatggtaggtatctgcccgcctgatgcatgcccagtgtttttggtggtatgaagttaatcacttctccttgcccttccagttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430429 - DNA, 1925 bp, Homo sapiens
agcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattgttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaaggttggaccttccattctcgacataaaatccccctgcttgaacctgtgtgtaattggtatttggtagcagaaaccacaaagtaacagtctgagaatcaggggcaagattgttaactagttgtatagaaagccactttcaactgttaaaaatttcttgctagcataaaaattactgttggcttcttgtgctgtgtcaaaacaatttgatcttttgttctgtgattcatggaaaccacagtaaatggatgtcactattaggctacaggattggagtaaaagaaattttgggcagaggaaagaaggtgaatttcccaagcccctgagctatagaagcactttgtgttagtttcttttcaatatttgtttttccttattcattcagtcctcataaaaatggagactctgtgaaacatcccatggcatctctttaatctgcataaccaaaactgagttctaattctgttctacttcagaacactttgctgtgtaccattcttcatttaaaaatctagccttaatttggactaggggtatgctctgatcaggatccgctagagca

SEQ ID NO: 430430 - DNA, 583 bp, Homo sapiens
tgctgagattatagatgtgagccatccacacttggccatcagggtaatatttttaatttgcctttttaaatagagagttaatgtatttatttgactttagtactcactaaattattacttttgtccatggagaggaaaggttatgagaaatgtaaatagggactatgatatttgaattagaatacccaaatagagcctttttatttatcattcacttcatttcctgtctgttggtcctccagcaattctcagtgaaggagttctacctgaagatcatcccctggcgcctttacaccttccgagtgtgtccaggaacaaaagtaagctgaaccttacatctggttcacatcaagcatgcttcatctctggactatctcagccttttattttttctcagaagcacttttagtgtttctgcaagatctcacagtgtacacaggattcgttgccaaataaagcatcattatctcctcactaaatggcatgaagaatatataaattctggaaggacgcatgcctacagaaacaggaattagcagcaactcagaatacttcaacagtgatcctttgccttcaagactaa

SEQ ID NO: 430431 - DNA, 341 bp, Homo sapiens
gagccggttcccaggccgggtggagaccaactctggggtctgttggtgggagagtggggagcccgtcttctgctgagtgctgccgccccttcccaggacagcggaggtggaacttcgtcgcgctgcaacccccggctcgggtaacgtttctctccagccttaggcagagcccagaagacctgcctttaccagagttccagagagagagggaggaaaagggtaggggggttcagactcctggtttgcccagtagtttgggggaacacattctcctcaccctgtagcgttggggtatccggtgtctatggtccagccctgaggctgtggttcctatttggttt

SEQ ID NO: 430432 - DNA, 5229 bp, Homo sapiens
agcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattgttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430433 - DNA, 4131 bp, Homo sapiens
ttattccttattatacttcagaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430434 - DNA, 3348 bp, Homo sapiens
agcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattgttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagaatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaaaaaaaaaa

SEQ ID NO: 430435 - DNA, 573 bp, Homo sapiens
agcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggtaacgtttctctccagccttaggcagagcccagaagacctgcctttaccagagttccagagagagagggaggaaaagggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaaggtaaggtaacagactgagttaagct

SEQ ID NO: 430436 - DNA, 3624 bp, Homo sapiens
ggcgtgggcagaggccaggagggtcagtggggtatgggctctatgaagatggtctcatcaagtgagcactcagtaggcaagaggacaaaaaggcacagcgaaggagggcctttctgtctgtgggtttctctgtccatctggggccatcagtgtccttgggcctgtgctctctcaggggctgtgccatggttaggtatccagcccaggagcgagggagaggcgggagtcctgggggtgaggcattgcctacattgtcacctgcccccaacctccaaggggatgcagtaaggagagggaagtccatagccgaaacacgaggccgggagatgctgatgccctcagtgaccctgcttgcaggaaagctctgacccagtccagtgcctggctctccacagatcgctggcctccccaacgacacactgtcagtggagaacggggtcatcaaccagttttcccagcgctggacccacttcattgaccctcagagccaggccaacaaatggatcaagaacatggagaaggacaatgggctggatgtgttcaagttgggtgaccgcgacttcctgcgcagcatggagaacgccatccgctttggcaagccatgtctcctggagaacgtgggcgaggagctagacccagccctggagccagtgctgctcaagcagacgtacaagcagcagggaagcacggtgctgaagctgggggacacggtgatcccctaccatgaggacttcaggatgtacatcaccaccaagctgcccaacccacactacacgcccgagatctccaccaaactcaccctcatcaacttcaccctgtcgcccagtggcctagaggaccagctactgggccaggtagtggcagaggagcgacccgacctggaggaggccaagaaccagctgattatcagtaatgccaagatgcgccaggagctgaaggacattgaggaccagatcctgtaccggctcagctcctccgagggcaaccctgtagatgacatggaactcatcaaggtgctggaagcctccaagatgaaggctgctgagatccaggccaaagtcaggattgcagagcagacggagaaggacatcgacctgacgcgcatggagtacatacccgtggccatccgcacccagatcctcttcttctgtgtgtccgacctggccaacgtggaccccatgtaccagtactcccttgagtggtttctcaacatcttcctctcgggcatcgccaactcagagagagcagacaacctgaagaagcgcatctccaacatcaaccgctacctgacctacagcctctacagcaacgtctgccgcagcctctttgagaagcacaagctgatgtttgccttcctgctgtgtgttcgcatcatgatgaacgagggcaaaatcaaccagagtgagtggcgatacctcctgtctgggggctccatctcgatcatgactgagaatccggcaccggactggctgtcagaccgggcttggcgagacatcctagcactctcgaacctgccaaccttttcctccttctcttccgacttcgtgaagcacctctcagaattccgggtcatcttcgacagccttgagccccaccgggagcctttgcctggcatctgggaccagtacctagaccagttccagaagctgctagtcctccgctgcctgcgtggggacaaggttaccaacgccatgcaggactttgtggccaccaacctggagccacgcttcattgaaccccagacagccaatctgtcagtggtgttcaaagactccaactccaccacacccctcatctttgtgctgtcacccggcacagaccctgctgccgacctctacaagtttgccgaagaaatgaagttctccaaaaagctctctgccatctccctgggccaggggcagggccctcgggcagaagccatgatgcgcagctccatagagaggggcaaatgggtcttcttccagaactgccacctggcaccaagctggatgccagccctagaacgcctcatcgagcacatcaaccccgacaaggtacacagggacttccgcctctggctcaccagcctgcccagcaacaagttcccagtgtccatcctgcagaacggctccaagatgaccattgagccgccacgcggtgtcagggccaacctgctgaagtcctatagtagccttggtgaagacttcctcaactcctgccacaaggtgatggagttcaagtctctgctgctgtctctgtgcttgttccatgggaacgccctggagcgccgtaagtttgggcccctgggcttcaacatcccctatgagttcacggatggagatctgcgcatctgcatcagccagctcaagatgttcctggacgaatatgatgacatcccctacaaggtcctcaagtacacggcaggggagatcaattacgggggccgtgtcactgatgactgggaccggcgctgcatcatgaacatcttggaggacttctacaaccctgacgtgctctcccctgagcacagctacagcgcctcgggcatctaccaccagatcccgcctacctacgacctccacggctacctctcctacatcaagagcctcccactcaatgatatgcctgagatctttggcctgcatgacaatgccaacatcacctttgcccagaacgagacgttcgccctcctgggcaccatcatccagctgcaacccaaatcatcttctgcaggcagccagggccgggaggagatagtggaggacgtcacccaaaacattctgctcaaggtgcctgagcctatcaacttgcaatgggtgatggccaagtacccagtgctgtatgaggaatcaatgaacacagtactagtacaagaggtcattaggtacaatcggctgctgcaggtgatcacacagacactgcaagacctactcaaggcactcaaggggctggtagtgatgtcctctcagctggagctgatggctgccagcctgtacaacaatactgtgcctgagctctggagtgccaaggcctacccatcgctcaagcctctgtcatcatgggtcatggacctgctgcaacgcctggactttctgcaggcctggatccaagatggcatcccagctgtcttctggatcagtggattcttcttcccccaggctttcttaacaggcactctgcagaattttgcccgcaaatttgtcatctccattgacaccatctcctttgatttcaaggtgatgtttgaggcaccatcagagttaacacaaagaccccaagtagggtgctatatccatggattattcctggaaggtgcccgctgggatccagaggccttccagctggctgagtctcagcccaaggagctgtacacagagatggccgttatctggctcttgccaacacccaaccgcaaggcccaggaccaggacttttacctgtgccccatctacaagacactgactcgtgctggaacactatcaaccacaggacactctaccaactatgtcattgctgtggagatccccacccatcagccccagcgacactggataaagcgtggtgtggccctcatctgtgccctggactactagactcagacagaagggctggggccattaaagctgaattttctaagcaaaaaag

SEQ ID NO: 430437 - DNA, 3967 bp, Homo sapiens
ggcgtgggcagaggccaggagggtcagtggggtatgggctctatgaagatggtctcatcaagtgagcactcagtaggcaagaggacaaaaaggcacagcgaaggagggcctttctgtctgtgggtttctctgtccatctggggccatcagtgtccttgggcctgtgctctctcaggggctgtgccatggttaggtatccagcccaggagcgagggagaggcgggagtcctgggggtgaggcattgcctacattgtcacctgcccccaacctccaaggggatgcagtaaggagagggaagtccatagccgaaacacgaggccgggagatgctgatgccctcagtgaccctgcttgcaggaaagctctgacccagtccagtgcctggctctccacagatcgctggcctccccaacgacacactgtcagtggagaacggggtcatcaaccagttttcccagcgctggacccacttcattgaccctcagagccaggccaacaaatggatcaagaacatggagaaggacaatgggctggatgtgttcaagttgggtgaccgcgacttcctgcgcagcatggagaacgccatccgctttggcaagccatgtctcctggagaacgtgggcgaggagctagacccagccctggagccagtgctgctcaagcagacgtacaagcagcagggaagcacggtgctgaagctgggggacacggtgatcccctaccatgaggacttcaggatgtacatcaccaccaagctgcccaacccacactacacgcccgagatctccaccaaactcaccctcatcaacttcaccctgtcgcccagtggcctagaggaccagctactgggccaggtagtggcagaggagcgacccgacctggaggaggccaagaaccagctgattatcagtaatgccaagatgcgccaggagctgaaggacattgaggaccagatcctgtaccggctcagctcctccgagggcaaccctgtagatgacatggaactcatcaaggtgctggaagcctccaagatgaaggctgctgagatccaggccaaagtcaggattgcagagcagacggagaaggacatcgacctgacgcgcatggagtacatacccgtggccatccgcacccagatcctcttcttctgtgtgtccgacctggccaacgtggaccccatgtaccagtactcccttgagtggtttctcaacatcttcctctcgggcatcgccaactcagagagagcagacaacctgaagaagcgcatctccaacatcaaccgctacctgacctacagcctctacagcaacgtctgccgcagcctctttgagaagcacaagctgatgtttgccttcctgctgtgtgttcgcatcatgatgaacgagggcaaaatcaaccagagtgagtggcgatacctcctgtctgggggctccatctcgatcatgactgagaatccggcaccggactggctgtcagaccgggcttggcgagacatcctagcactctcgaacctgccaaccttttcctccttctcttccgacttcgtgaagcacctctcagaattccgggtcatcttcgacagccttgagccccaccgggagcctttgcctggcatctgggaccagtacctagaccagttccagaagctgctagtcctccgctgcctgcgtggggacaaggttaccaacgccatgcaggactttgtggccaccaacctggagccacgcttcattgaaccccagacagccaatctgtcagtggtgttcaaagactccaactccaccacacccctcatctttgtgctgtcacccggcacagaccctgctgccgacctctacaagtttgccgaagaaatgaagttctccaaaaagctctctgccatctccctgggccaggggcagggccctcgggcagaagccatgatgcgcagctccatagagaggggcaaatgggtcttcttccagaactgccacctggcaccaagctggatgccagccctagaacgcctcatcgagcacatcaaccccgacaaggtacacagggacttccgcctctggctcaccagcctgcccagcaacaagttcccagtgtccatcctgcagaacggctccaagatgaccattgagccgccacgcggtgtcagggccaacctgctgaagtcctatagtagccttggtgaagacttcctcaactcctgccacaaggtgatggagttcaagtctctgctgctgtctctgtgcttgttccatgggaacgccctggagcgccgtaagtttgggcccctgggcttcaacatcccctatgagttcacggatggagatctgcgcatctgcatcagccagctcaagatgttcctggacgaatatgatgacatcccctacaaggtcctcaagtacacggcaggggagatcaattacgggggccgtgtcactgatgactgggaccggcgctgcatcatgaacatcttggaggacttctacaaccctgacgtgctctcccctgagcacagctacagcgcctcgggcatctaccaccagatcccgcctacctacgacctccacggctacctctcctacatcaagagcctcccactcaatgatatgcctgagatctttggcctgcatgacaatgccaacatcacctttgcccagaacgagacgttcgccctcctgggcaccatcatccagctgcaacccaaatcatcttctgcaggcagccagggccgggaggagatagtggaggacgtcacccaaaacattctgctcaaggtgcctgagcctatcaacttgcaatgggtgatggccaagtacccagtgctgtatgaggaatcaatgaacacagtactagtacaagaggtcattaggtacaatcggctgctgcaggtgatcacacagacactgcaagacctactcaaggcactcaaggggctggtagtgatgtcctctcagctggagctgatggctgccagcctgtacaacaatactgtgcctgagctctggagtgccaaggcctacccatcgctcaagcctctgtcatcatgggtcatggacctgctgcaacgcctggactttctgcaggcctggatccaagatggcatcccagctgtcttctggatcagtggattcttcttcccccaggctttcttaacaggcactctgcagaattttgcccgcaaatttgtcatctccattgacaccatctcctttgatttcaaggtctgggcacagccagggccaggtcaggtgacaggctatggtacagcccaaggaggagaggctctgaggccacggttggttggcagttgggggacccctaagccagggcatggaaagacccaagccagaagaggccatgagtcccaggaacgggtctgggctgggtccatcagaaatccacaggggcagggcacagaccacaggccatgggctaaagtggtaggtacgtgatgatgggcaggcaggcagcattaggcagctctctcagaagggagttttgtgcctcctaacccagattctgggtattgttatgtgtgtggggtgtgtctgtgtctacccacaggtgatgtttgaggcaccatcagagttaacacaaagaccccaagtagggtgctatatccatggattattcctggaaggtgcccgctgggatccagaggccttccagctggctgagtctcagcccaaggagctgtacacagagatggccgttatctggctcttgccaacacccaaccgcaaggcccaggaccaggacttttacctgtgccccatctacaagacactgactcgtgctggaacactatcaaccacaggacactctaccaactatgtcattgctgtggagatccccacccatcagccccagcgacactggataaagcgtggtgtggccctcatctgtgccctggactactagactcagacagaagggctggggccattaaagctgaattttctaagcaaaaaag

SEQ ID NO: 430438 - DNA, 3707 bp, Homo sapiens
ggcgtgggcagaggccaggagggtcagtggggtatgggctctatgaagatggtctcatcaagtgagcactcagtaggcaagaggacaaaaaggcacagcgaaggagggcctttctgtctgtgggtttctctgtccatctggggccatcagtgtccttgggcctgtgctctctcaggggctgtgccatggttaggtatccagcccaggagcgagggagaggcgggagtcctgggggtgaggcattgcctacattgtcacctgcccccaacctccaaggggatgcagtaaggagagggaagtccatagccgaaacacgaggccgggagatgctgatgccctcagtgaccctgcttgcaggaaagctctgacccagtccagtgcctggctctccacagatcgctggcctccccaacgacacactgtcagtggagaacggggtcatcaaccagttttcccagcgctggacccacttcattgaccctcagagccaggccaacaaatggatcaagaacatggagaaggacaatgggctggatgtgttcaagttgggtgaccgcgacttcctgcgcagcatggagaacgccatccgctttggcaagccatgtctcctggagaacgtgggcgaggagctagacccagccctggagccagtgctgctcaagcagacgtacaagcagcagggaagcacggtgctgaagctgggggacacggtgatcccctaccatgaggacttcaggatgtacatcaccaccaagctgcccaacccacactacacgcccgagatctccaccaaactcaccctcatcaacttcaccctgtcgcccagtggcctagaggaccagctactgggccaggtagtggcagaggagcgacccgacctggaggaggccaagaaccagctgattatcagtaatgccaagatgcgccaggagctgaaggacattgaggaccagatcctgtaccggctcagctcctccgagggcaaccctgtagatgacatggaactcatcaaggtgctggaagcctccaagatgaaggctgctgagatccaggccaaagtcaggattgcagagcagacggagaaggacatcgacctgacgcgcatggagtacatacccgtggccatccgcacccagatcctcttcttctgtgtgtccgacctggccaacgtggaccccatgtaccagtactcccttgagtggtttctcaacatcttcctctcgggcatcgccaactcagagagagcagacaacctgaagaagcgcatctccaacatcaaccgctacctgacctacagcctctacagcaacgtctgccgcagcctctttgagaagcacaagctgatgtttgccttcctgctgtgtgttcgcatcatgatgaacgagggcaaaatcaaccagagtgagtggcgatacctcctgtctgggggctccatctcgatcatgactgagaatccggcaccggactggctgtcagaccgggcttggcgagacatcctagcactctcgaacctgccaaccttttcctccttctcttccgacttcgtgaagcacctctcagaattccgggtcatcttcgacagccttgagccccaccgggagcctttgcctggcatctgggaccagtacctagaccagttccagaagctgctagtcctccgctgcctgcgtggggacaaggttaccaacgccatgcaggactttgtggccaccaacctggagccacgcttcattgaaccccagacagccaatctgtcagtggtgttcaaagactccaactccaccacacccctcatctttgtgctgtcacccggcacagaccctgctgccgacctctacaagtttgccgaagaaatgaagttctccaaaaagctctctgccatctccctgggccaggggcagggccctcgggcagaagccatgatgcgcagctccatagagaggggcaaatgggtcttcttccagaactgccacctggcaccaagctggatgccagccctagaacgcctcatcgagcacatcaaccccgacaaggtacacagggacttccgcctctggctcaccagcctgcccagcaacaagttcccagtgtccatcctgcagaacggctccaagatgaccattgagccgccacgcggtgtcagggccaacctgctgaagtcctatagtagccttggtgaagacttcctcaactcctgccacaaggtgatggagttcaagtctctgctgctgtctctgtgcttgttccatgggaacgccctggagcgccgtaagtttgggcccctgggcttcaacatcccctatgagttcacggatggagatctgcgcatctgcatcagccagctcaagatgttcctggacgaatatgatgacatcccctacaaggtcctcaagtacacggcaggggagatcaattacgggggccgtgtcactgatgactgggaccggcgctgcatcatgaacatcttggaggacttctacaaccctgacgtgctctcccctgagcacagctacagcgcctcgggcatctaccaccagatcccgcctacctacgacctccacggctacctctcctacatcaagagcctcccactcaatgatatgcctgagatctttggcctgcatgacaatgccaacatcacctttgcccagaacgagacgttcgccctcctgggcaccatcatccagctgcaacccaaatcatcttctgcaggcagccagggccgggaggagatagtggaggacgtcacccaaaacattctgctcaaggtgcctgagcctatcaacttgcaatgggtgatggccaagtacccagtgctgtatgaggaatcaatgaacacagtactagtacaagaggtcattaggtacaatcggctgctgcaggtgatcacacagacactgcaagacctactcaaggcactcaaggggctggtagtgatgtcctctcagctggagctgatggctgccagcctgtacaacaatactgtgcctgagctctggagtgccaaggcctacccatcgctcaagcctctgtcatcatgggtcatggacctgctgcaacgcctggactttctgcaggcctggatccaagatggcatcccagctgtcttctggatcagtggattcttcttcccccaggctttcttaacaggcactctgcagaattttgcccgcaaatttgtcatctccattgacaccatctcctttgatttcaaggtgatgtttgaggcaccatcagagttaacacaaagaccccaagtagggtgctatatccatggattattcctggaaggtgcccgctgggatccagaggccttccagctggctgagtctcagcccaaggagctgtacacagagatggccgttatctggctcttgccaacacccaaccgcaaggcccaggaccaggacttttacctgtgccccatctacaagacactgactcgtgctggtatgaggcctgggatgggagcctacactatgggcggggacccaggactaacccagcccagcccaagccagtcacttatccaggaacactatcaaccacaggacactctaccaactatgtcattgctgtggagatccccacccatcagccccagcgacactggataaagcgtggtgtggccctcatctgtgccctggactactagactcagacagaagggctggggccattaaagctgaattttctaagcaaaaaag

SEQ ID NO: 430439 - DNA, 232 bp, Homo sapiens
gcgcatggagtacatacccgtggccatccgcacccagatcctcttcttctgtgtgtccgacctggccaacgtggaccccatgtaccagtactcccttgagtggtttctcaacatcttcctctcgggcatcgccaactcagagagagcaggtagcaccggcatgccaggctcctaccctgcacagatatgacccatgtggacacatttccactgtggggcacacacaaactca

SEQ ID NO: 430440 - DNA, 1924 bp, Homo sapiens
tcatcttcagatctgatcttattttgctacttaggagttctgatactgggcaagtcacctagcctgtgagcttcatttgcttatacagttgttggaattagatgtggtgacatgcgaaaagcacaaaacctggctcctatcaagcttctgcatctatttttttttctatttttctctcaattattggaagctcatagaagcattttgggatagaattttagtagtttgcaagtatttttaaacattttatcataggtacacttataattttgatatgatctcagtattaacctgataactcccaaattgatattttcctagttcaactgaaattaaagggagaaatatgggattgtaggagtgccttgtcctcaaattgactgtatttctgttttgagaaagatcttggtactgatcacgtagtcaactttctaatgcaatgttaaagtttatatatttgtaaatgttattgttataaaagcataaaaccagaaattaagtcttagatttagtttctacatcttttattggaagatgactgtagataaatatctttctgtatatcattttaataaatgagaaaagagagctgttgaatgaaagatcatgaacatcagtatttatctgaggaacatcctgcggaggaatccctttccccatttattaaacacaaaattgccagtgtttcaagtagttctctgatcgatagaccaacaactgaaattaaatgcttttagtctcaagtgcccatttttattaaaatgtaattatcatgaacagaaaaagcaatacaaggcgtgtgttcttaataattctgccattctctttttgacatttaaaggagaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaatt

SEQ ID NO: 430441 - DNA, 334 bp, Homo sapiens
  misc_feature (2)..(2): n is a, c, g, or t
  misc_feature (7)..(7): n is a, c, g, or t
tncggcngcgagaagacgacagaagggtacggctgcgagagacgacagaggggagaacgcatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaatt

SEQ ID NO: 430442 - DNA, 1695 bp, Homo sapiens
agcttccacggagggcgcaggacccagggcgctgaactctcacaaccaatcaggcgacccccccagagggaaactacaagtcccagcatgccccacgcgcaccgtcaggggccgacccgccgcgccccagcgttctccgcgtacaggtggtctcttgggttccggtaaggcggcggctgcggaactcccgtggaggggccggtgggccctcgggcctgacgatggcagtggccactgcggcggcagtactggccgctctgggcggggcgctgtggctggcggcccgccggttcgtggggcccagggtccagcggctgcgcagaggcggggaccccggcctcatgcacgggaagactgtgctgatcaccggggcgaacagcggcctgggccgcgccacggccgccgagctactgcgcctgggagcgcgggtgatcatgggctgccgggaccgcgcgcgcgccgaggaggcggcgggtcagctccgccgcgagctccgccaggccgcggagtgcggcccagagcctggcgtcagcggggtgggcgagctcatagtccgggagctggacctcgcctcgctgcgctcggtgcgcgccttctgccaggaaatgctccaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaatt

SEQ ID NO: 430443 - DNA, 1898 bp, Homo sapiens
  misc_feature (1697)..(1697): n is a, c, g, or t
  misc_feature (1701)..(1701): n is a, c, g, or t
agcttccacggagggcgcaggacccagggcgctgaactctcacaaccaatcaggcgacccccccagagggaaactacaagtcccagcatgccccacgcgcaccgtcaggggccgacccgccgcgccccagcgttctccgcgtacaggtggtctcttgggttccggtaaggcggcggctgcggaactcccgtggaggggccggtgggccctcgggcctgacgatggcagtggccactgcggcggcagtactggccgctctgggcggggcgctgtggctggcggcccgccggttcgtggggcccagggtccagcggctgcgcagaggcggggaccccggcctcatgcacgggaagactgtgctgatcaccggggcgaacagcggcctgggccgcgccacggccgccgagctactgcgcctgggagcgcgggtgatcatgggctgccgggaccgcgcgcgcgccgaggaggcggcgggtcagctccgccgcgagctccgccaggccgcggagtgcggcccagagcctggcgtcagcggggtgggcgagctcatagtccgggagctggacctcgcctcgctgcgctcggtgcgcgccttctgccaggaaatgctccaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaattanaaanaaaaaaaaaaaaaaaagggcgggcgccggctctcatagagagaagttatctcccccttcagaggagggcgccccaaaagagctttacagcgcgttccacccaggatttctcttgtgttcccaagggtggcgcccttaaataagggagagtcggatatatataaagcttgaggcccatggggcacgagagcgggttaa

SEQ ID NO: 430444 - DNA, 1139 bp, Homo sapiens
  misc_feature (22)..(22): n is a, c, g, or t
  misc_feature (25)..(25): n is a, c, g, or t
  misc_feature (36)..(36): n is a, c, g, or t
  misc_feature (49)..(49): n is a, c, g, or t
  misc_feature (57)..(57): n is a, c, g, or t
gcagggggggcgcaggggaganagnaaagttttggnccgtcttggcganaaagaccnagaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaatt

SEQ ID NO: 430445 - DNA, 1245 bp, Homo sapiens
agcttccacggagggcgcaggacccagggcgctgaactctcacaaccaatcaggcgacccccccagagggaaactacaagtcccagcatgccccacgcgcaccgtcaggggccgacccgccgcgccccagcgttctccgcgtacaggtggtctcttgggttccggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaatt

SEQ ID NO: 430446 - DNA, 1077 bp, Homo sapiens
atgggttggattttatactaactctagtttttactagaaatttaatctctgattattttaaatgagccagaatagctttaaaagaaagttctgttatattgactaacagaatgaaagggaacctgctttgggatttcacaagcaagtttttcatacttgtgagaattctaagtatccatcactgttctttaaatgcatttgatgagatgggccctccaggagccacagaattcatcctcctctctctagggctatgcctgttgctttcattacccttttataatttgtggctgcagggagaggctctgttaagatatttcagaatataaatgctactacttttcatttctgttcttttcttgcctttccaagtgtgcacagggacttgtgcagctagagattggaagactccgagctggttcctggacctccgcaaggacgacatcacagaacagtcaggttgtcgatggcttctcatcagactgactcactcttctgcccccactgggagaaagttccccatttaataaatggttgtttggaaataatatctaatgtacagcatattcacagcaccaagtttagtgaactttcatgtgtttgaaataaaaatgaaaggtgggatggaaattcattaatccctagatttttctctcctttattgcttgcaaatgttttcttggaagctcttttctctctattagttctatattgcctatgcacgcatgtacacagctgtgtttatttaaaaaaaaaaaaaggcaacatctggtggcaatttgaccctcattagcacaacattgttctattcattcaattaaatattgctataaagttaacttgtgactagccactcacacatgccgagggcaattaatggcatattcctaggagaaccaagtgtgggggtttttcctgtgggagggagggcttagtgggtgatattttgtgggttagcaaacatcttatatttatttgcaaagctgatgtaagtgccatttttttttagcaaagtatatttcactatatttttttcattgtaatggctgacaaaatcaagatggtagactgtatggt

SEQ ID NO: 430447 - DNA, 606 bp, Homo sapiens
tgctaatcaaggtcttattatacttgttttagcaaaatacataatacattttgggtaataaagttgactgtaaccccaaatgaaacatagtgcccattagctgactatatatacataaacactatgtggcaacctaggaaaatggttttgattttatgtggagcaagaacagctgaaatgattctatggtctccaccttggtgattgaaaccatatacaaaagcacacataatggagaaagcaatggaggaaatgtctaaatgggattgggttgaggtagtaagagaatagtgtgggtgatttttgttttctttcctggcctcctcacgattttctgttagatggttatggtgacatcagtaattggcacactaatggataagtatgcatttagggggtcaagtcagtgtctgcacacaggtgacccctgggtctttctttcagggtagtcagcagagtgcacacagcagctgtcatccctccttcgctcctgtcatcactggcctgcaaaacctggttggcacaaaaagagtttcagatccttcccagaaaaattcaggtattacacggacacacccagagcaaaactatcctgttacccaaatt

SEQ ID NO: 430448 - DNA, 720 bp, Homo sapiens
gagacactcttaaaaaaaaaaaaaaaaaaaaaagtttgagagaatagtccttgtgtcaaatggtctagataaattgaataagattaggattgagaactgacccttggatacagcatggtttctctaattctccccttctttataatgaaatacctttttttcactttttccccaggttgtagcagataccaatataagcgccatagcagctcagcttgaaaacatgtctacaggctaccaccttggttcgcccactgctgaacaccatccagaagacacagagtgagtatttcagatgcagagggcctattatgcatgtgggcaaagctcggaagaacttttccagacactcaagtgcactctaaaggagaagtggccaaagcgcccgtgactttttctaaattctagggaatccttatttctcacaaggcttaattccaccacatgagttcttgaaagaccattgttgcagggcctgcacacacactgcatctggtcactttgacacagtgcctatgcctgcttccctaagaaaccacggatgtatagcccaggtgcacgctgctttattgtgcaaggaaccacgtttcctgaacttctaggctaaaatcttgttctgagatgaaatcttgttgttatacttgctgacatgtttcattaaaaccagtcatcgcagttaaagttgttcattaaagcagggtttctcaaactaaaaaaaag

SEQ ID NO: 430449 - DNA, 4653 bp, Homo sapiens
  misc_feature (1630)..(1631): n is a, c, g, or t
  misc_feature (1701)..(1701): n is a, c, g, or t
  misc_feature (1787)..(1787): n is a, c, g, or t
  misc_feature (1805)..(1805): n is a, c, g, or t
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttgagacggagtctcactctgtcacccaggctggagtgcaatggcgcaatcnnggctcactgcaacctcggcctcccaggttggagcgattctcctgcctcagcctcccgagtagctgggatnacaggcatgcatcaccacactgggtttatttttgtttttttagtagagatggagcttccccatgtgggccaggctggtcttgaacntctgacctcaggtgatcngcctgccttggcctcccaaagtgctgggattccaggcgtgagccactgcgcccagcccagtattctgattttaaccaactggttctgattatatttaccaaaactggagttaacttctctttccttatactcttctctccctatcccctactcacaccgaggcttaacagcaacctcagatctcatccaatggacagaaacaaatgttaagcaacttgtcatctcactcatgatttacttatgctaattgtctcttcaagtaagcaagaaaacattagcagtgtaattaatttaccagtgatccccaagatgaaataccagattctcctatgggaaattactgtgctgtcttctgtatgacttatggtcaaataagtctcaaattcatttctctggatagatctttatatgctagtcattggtgattttgatgagtcaatttacagactgtaatcttctaaaaattctgaaagactaattgttttctgtgccatataaatgcataccactgagcaaatgaaccttattctcagcaggaacaactagcatacatgttctgaattctaacagtgctaaattacattcaagtccaggaagatcacctggaattaatggcatttcagttggcaggcatcattcccacccctcggtcttaggaaaaggaggtagaagccccagaaccacacggcagagatcagcaagttttgtctcaagtcagacaaggtctaggtggccttggccttatgcaaagtgggtgacatatttgattatatttccctttacctccatagtagtcaggccagcagcatggactgcaagaacctaagggagcaacatacttagctgcaaagtgagcaaatgaattgagcctaggaatatgtgatgaaaatgcatggctgatgtttcctgatctccaaggagactcccatttgctgaagttttgcatgctaagaaatcaactacagcagaaaatacaagaatacctttaagttgattattggcaatcttattcatatattagcaagaaaaagggagagatgcttactggtggatgctatagagtcctctgtttttaaaagtaccatggccgggtgcagtggctcacgcctgtaatcccagcactttgggaggccagggcaggcgaatcatgaggtcaggagttcgagaccagcctggccaatatggtgaaaccctgtctctactaaaaatacaaaaattagctgggtgcagtggcaggcgcctgtaatcccagctactccggaggttgaagcaggaaaattgcttgaacctgggaggtggaggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagataatacattgttgtggtgtttctttatacattatccttttaggtcgtgctagtaaaagtatattgatgaaggaattatgatgctttatacttcttactgcactaaattgatagaactagtacttgtcataatcggttctgtctccgctcacatgactaatacgtaattgcctttccaaaaagatatttttgcctcagaacttactgacaagctgagaggctatgaagatggaaatttgtgaaagaagtagtgctcttatatttggcctcatcatttgggccatttcagtatagtaatgatatcactaatcggaattagcatgagagggaagtaagccaggaagaataaaactgctgaatgtttgtatgtgtaagatatttccaaagattctaaataaatgtagttgcctacagagcaaatggagttttattatatatgaaaaagtgtactttctggatctaattgtgctttttcttcagcattttcttccctaatagaaaaaaaaaaaaagtccaacttttcacaaggttttttggtgtcctgttaaaatctggaatccatgtggctcaggatccatgccgccatgcccagccaacctctaatgtttctttcctggccctttcatgcatgtgcaggtgagtatttgacaaagaggcgatctccatggctctgtcaacctacagctccctcctttccagacactacatgttctagccaacttggctggcctccctgaacgtgaatctctttctcctctactcgtggactctgtgtgagtttccccttcctgagtgtgacatggatactgcctccagggataaaactgggacagttgtagaatttaccttgttttccttcttgcagggatcaaaatcctatgctgcctgttatctgatgtctaaaaatgtttcatatattatgtccattt

SEQ ID NO: 430450 - DNA, 3546 bp, Homo sapiens
  misc_feature (523)..(524): n is a, c, g, or t
  misc_feature (594)..(594): n is a, c, g, or t
  misc_feature (680)..(680): n is a, c, g, or t
  misc_feature (698)..(698): n is a, c, g, or t
attaaactgaaatgtttcttgtttgtagggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttgagacggagtctcactctgtcacccaggctggagtgcaatggcgcaatcnnggctcactgcaacctcggcctcccaggttggagcgattctcctgcctcagcctcccgagtagctgggatnacaggcatgcatcaccacactgggtttatttttgtttttttagtagagatggagcttccccatgtgggccaggctggtcttgaacntctgacctcaggtgatcngcctgccttggcctcccaaagtgctgggattccaggcgtgagccactgcgcccagcccagtattctgattttaaccaactggttctgattatatttaccaaaactggagttaacttctctttccttatactcttctctccctatcccctactcacaccgaggcttaacagcaacctcagatctcatccaatggacagaaacaaatgttaagcaacttgtcatctcactcatgatttacttatgctaattgtctcttcaagtaagcaagaaaacattagcagtgtaattaatttaccagtgatccccaagatgaaataccagattctcctatgggaaattactgtgctgtcttctgtatgacttatggtcaaataagtctcaaattcatttctctggatagatctttatatgctagtcattggtgattttgatgagtcaatttacagactgtaatcttctaaaaattctgaaagactaattgttttctgtgccatataaatgcataccactgagcaaatgaaccttattctcagcaggaacaactagcatacatgttctgaattctaacagtgctaaattacattcaagtccaggaagatcacctggaattaatggcatttcagttggcaggcatcattcccacccctcggtcttaggaaaaggaggtagaagccccagaaccacacggcagagatcagcaagttttgtctcaagtcagacaaggtctaggtggccttggccttatgcaaagtgggtgacatatttgattatatttccctttacctccatagtagtcaggccagcagcatggactgcaagaacctaagggagcaacatacttagctgcaaagtgagcaaatgaattgagcctaggaatatgtgatgaaaatgcatggctgatgtttcctgatctccaaggagactcccatttgctgaagttttgcatgctaagaaatcaactacagcagaaaatacaagaatacctttaagttgattattggcaatcttattcatatattagcaagaaaaagggagagatgcttactggtggatgctatagagtcctctgtttttaaaagtaccatggccgggtgcagtggctcacgcctgtaatcccagcactttgggaggccagggcaggcgaatcatgaggtcaggagttcgagaccagcctggccaatatggtgaaaccctgtctctactaaaaatacaaaaattagctgggtgcagtggcaggcgcctgtaatcccagctactccggaggttgaagcaggaaaattgcttgaacctgggaggtggaggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagataatacattgttgtggtgtttctttatacattatccttttaggtcgtgctagtaaaagtatattgatgaaggaattatgatgctttatacttcttactgcactaaattgatagaactagtacttgtcataatcggttctgtctccgctcacatgactaatacgtaattgcctttccaaaaagatatttttgcctcagaacttactgacaagctgagaggctatgaagatggaaatttgtgaaagaagtagtgctcttatatttggcctcatcatttgggccatttcagtatagtaatgatatcactaatcggaattagcatgagagggaagtaagccaggaagaataaaactgctgaatgtttgtatgtgtaagatatttccaaagattctaaataaatgtagttgcctacagagcaaatggagttttattatatatgaaaaagtgtactttctggatctaattgtgctttttcttcagcattttcttccctaatagaaaaaaaaaaaaagtccaacttttcacaaggttttttggtgtcctgttaaaatctggaatccatgtggctcaggatccatgccgccatgcccagccaacctctaatgtttctttcctggccctttcatgcatgtgcaggtgagtatttgacaaagaggcgatctccatggctctgtcaacctacagctccctcctttccagacactacatgttctagccaacttggctggcctccctgaacgtgaatctctttctcctctactcgtggactctgtgtgagtttccccttcctgagtgtgacatggatactgcctccagggataaaactgggacagttgtagaatttaccttgttttccttcttgcagggatcaaaatcctatgctgcctgttatctgatgtctaaaaatgtttcatatattatgtccattt

SEQ ID NO: 430451 - DNA, 3727 bp, Homo sapiens
  misc_feature (1630)..(1631): n is a, c, g, or t
  misc_feature (1701)..(1701): n is a, c, g, or t
  misc_feature (1787)..(1787): n is a, c, g, or t
  misc_feature (1805)..(1805): n is a, c, g, or t
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttgagacggagtctcactctgtcacccaggctggagtgcaatggcgcaatcnnggctcactgcaacctcggcctcccaggttggagcgattctcctgcctcagcctcccgagtagctgggatnacaggcatgcatcaccacactgggtttatttttgtttttttagtagagatggagcttccccatgtgggccaggctggtcttgaacntctgacctcaggtgatcngcctgccttggcctcccaaagtgctgggattccaggcgtgagccactgcgcccagcccagtattctgattttaaccaactggttctgattatatttaccaaaactggagttaacttctctttccttatactcttctctccctatcccctactcacaccgaggcttaacagcaacctcagatctcatccaatggacagaaacaaatgttaagcaacttgtcatctcactcatgatttacttatgctaattgtctcttcaagtaagcaagaaaacattagcagtgtaattaatttaccagtgatccccaagatgaaataccagattctcctatgggaaattactgtgctgtcttctgtatgacttatggtcaaataagtctcaaattcatttctctggatagatctttatatgctagtcattggtgattttgatgagtcaatttacagactgtaatcttctaaaaattctgaaagactaattgttttctgtgccatataaatgcataccactgagcaaatgaaccttattctcagcaggaacaactagcatacatgttctgaattctaacagtgctaaattacattcaagtccaggaagatcacctggaattaatggcatttcagttggcaggcatcattcccacccctcggtcttaggaaaaggaggtagaagccccagaaccacacggcagagatcagcaagttttgtctcaagtcagacaaggtctaggtggccttggccttatgcaaagtgggtgacatatttgattatatttccctttacctccatagtagtcaggccagcagcatggactgcaagaacctaagggagcaacatacttagctgcaaagtgagcaaatgaattgagcctaggaatatgtgatgaaaatgcatggctgatgtttcctgatctccaaggagactcccatttgctgaagttttgcatgctaagaaatcaactacagcagaaaatacaagaatacctttaagttgattattggcaatcttattcatatattagcaagaaaaagggagagatgcttactggtggatgctatagagtcctctgtttttaaaagtaccatggccgggtgcagtggctcacgcctgtaatcccagcactttgggaggccagggcaggcgaatcatgaggtcaggagttcgagaccagcctggccaatatggtgaaaccctgtctctactaaaaatacaaaaattagctgggtgcagtggcaggcgcctgtaatcccagctactccggaggttgaagcaggaaaattgcttgaacctgggaggtggaggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagata

SEQ ID NO: 430452 - DNA, 3160 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttgagacggagtctcactctgtcacccaggctggagttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagataatacattgttgtggtgtttctttatacattatccttttaggtcgtgctagtaaaagtatattgatgaaggaattatgatgctttatacttcttactgcactaaattgatagaactagtacttgtcataatcggttctgtctccgctcacatgactaatacgtaattgcctttccaaaaagatatttttgcctcagaacttactgacaagctgagaggctatgaagatggaaatttgtgaaagaagtagtgctcttatatttggcctcatcatttgggccatttcagtatagtaatgatatcactaatcggaattagcatgagagggaagtaagccaggaagaataaaactgctgaatgtttgtatgtgtaagatatttccaaagattctaaataaatgtagttgcctacagagcaaatggagttttattatatatgaaaaagtgtactttctggatctaattgtgctttttcttcagcattttcttccctaatagaaaaaaaaaaaaagtccaacttttcacaaggttttttggtgtcctgttaaaatctggaatccatgtggctcaggatccatgccgccatgcccagccaacctctaatgtttctttcctggccctttcatgcatgtgcaggtgagtatttgacaaagaggcgatctccatggctctgtcaacctacagctccctcctttccagacactacatgttctagccaacttggctggcctccctgaacgtgaatctctttctcctctactcgtggactctgtgtgagtttccccttcctgagtgtgacatggatactgcctccagggataaaactgggacagttgtagaatttaccttgttttccttcttgcagggatcaaaatcctatgctgcctgttatctgatgtctaaaaatgtttcatatattatgtccattt

SEQ ID NO: 430453 - DNA, 1515 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgatcgtccacgggattctacacagtatctgacgatgtatacgacggccagtaccagcggagctgacagtgattagagga

SEQ ID NO: 430454 - DNA, 1498 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggtattgcgatcaacggagcacgcagctgtgcaaggcagataagtggcatgcaaaaaagattgagcgtcactggcagtagacatcgccacccagcagggtgcttgctgatgtgaattacgaaggttgaaagcaagaaattattatttttattcagaaattctttaatgccacccatacaggtagtgagcatgattatatgaaagcataacaaggggagaaaaattactctctgcttcacatgataaatcaacacagcttttagtttccagtgttcttttgtaaatcagaatttgtaaggaataagaaatgatttcttttcttatgcccaaagactgttactgaactgcccaagtgctgtttcttcttttccccttaaaggaagaggaaaaatacaatggtctttttcctttagcatagattgccaacactgttaaattgtcacgcgtagcagtcatcaaccaaggcagaca

SEQ ID NO: 430455 - DNA, 1573 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagagtgagtatttcagatgcagagggcctattatgcatgtgggcaaagctcggaagaacttttccagacactcaagtgcactctaaaggagaagtggccaaagcgcccgtgactttttctaaattctagggaatccttatttctcacaaggcttaattccaccacatgagttcttgaaagaccattgttgcagggcctgcacacacactgcatctggtcactttgacacagtgcctatgcctgcttccctaagaaaccacggatgtatagcccaggtgcacgctgctttattgtgcaaggaaccacgtttcctgaacttctaggctaaaatcttgttctgagatgaaatcttgttgttatacttgctgacatgtttcattaaaaccagtcatcgcagttaaagttgttcattaaagcagggtttctcaaactaaaaaaaag

SEQ ID NO: 430456 - DNA, 1257 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaggagcagctgcagatgacggccgattaaaacgaggggatcagattttagctctggaaaatgagttcaaaaatttcagtgtactgtcatacggatgtcgggatacagagatcattttttcctt

SEQ ID NO: 430457 - DNA, 2568 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacggtaaagacgtgctgtgggagttgggatctgcctttttcatccagagctctgatgcctgtgaacactgaaagagaaagcctaatgtaaagtagtgatgggatttctaaaaataagatatttatgaaaatttgacaacatgggtcatatttctgagcaaggtcttaccagaaaaattgtcatatcaagatagaactccaagtccaatcaatccagactgatatatttctgtacagagtaagaacaactagcaaggttctttcacttggaattactaagatcggagttttgcagaggttgattaaagcaaccatacccaagaaatagctagcatcaagaatgagatttatccaatgttgggtcaagaacattgcttcgacatggaaattaacatggaacattgcttttcgtgatactgttaatttcatactatgttgaaactagttgagtagacatagttaagagataaacataattcttcacgatagtagttttctattaagaaaaatgtcctgctgggcacagtggcatgtacctgttgtctcagctatgtgggaagatcacttgaggccaggagttcaaggctatagtgtgctatgatcatgcctgtgaatagccactgcacttgagcctcttgggaaacataacaagaccccatctgtaaataaaaaaaaaaaaaagaaaaggaaaaaagaaagatgtccccaaagtaatagtttgcaccaaaaatgtaggtaggtagatcctagtggccaggctactcttttgaaatatatgttgctgccagatgcagtggctcatgcctgtagtcccagcactttgggaggccgaggtgggtggatcacctgaggtcaggagttcaagaccagcctgaccaatatggtgaaaccccatctctactaaaaaatacaaaaaattagccaggcatagtggcagatgcctgtaatcccagctacttgggagactgaggcaggagaattgcttgaacttgggaggtggaggttgcagtgagctgagatcacgccattgcattccagcctgtgcaacaagagcgaaactccatctcaaaaataaataaataaataaaaagaggtatatgttgcctaggccaggcatagtggctcacgtctataatcccaacactttgggaagctgagttgggaggatcgcttgaggtgaggagttcaagatcagtctggcaacatagcaagacttgtctctaaaaaaattttttaaataaagaaaaatgaagtctatactgcttaacagtcgtttgttccaggataatattactaagtttctcttgcagtgaattggaaaggtaagtaatagcttgaaacaaagcctagcttccatggtttactggcttttaggtatctagtatgtatttatcccaacagggctataggatttccaggtaatatcctaatatggccttaaagtgtatcaaccatcttgttaaggaagaaatcaagttgcttttatgcatgttatgttatatgccctcacagacctctggtgactagcctagtgtctgtccagcaggccaagctgttattaaaataaaaatattagctacaatttttgagtactgattttgggccaagtattgtgctgtcataatttcatttttttttacttcagcaccatagaaccatcactctgaaaatgcattaccaaacaaaaaaagctgagtctcttacatttctaaacaaaaatcagtgcacatctgggtgcagagcaactgacagagccagtgttgaagtttgctttcttgttttgacacatgcgtatacctggtgcggttttatttacagcaatgttttttgcttttagtgaatgtcagtatttcaggttgagtttgtaaggaacatttacattccttagcacaaaaacttgcattgtaaaggatgagatgtatagttctcaaaagtcactattttctttgactaacaattccatcaccaggactttatcttaaagatatacttacaagtattcattgctcattgcaatagttaaagaatggaaataacctgtatgtccatcagtaagctactggtaagtgaaattatgaaacatcatagaatagtatgtagctatttaaaaaatgaggaagctccaagtgctgataaaggcaaattaccaaggtatgaaag

SEQ ID NO: 430458 - DNA, 1014 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagtaaacgagagaactggttgaaagactaacaatatgtgttggggtgggagaggaagttgcagccctgggcaccttgtttaaagttggaatt

SEQ ID NO: 430459 - DNA, 1265 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcaggttgtcgatggcttctcatcagactgactcactcttctgcccccactgggagaaagttccccatttaataaatggttgtttggaaataatatctaatgtacagcatattcacagcaccaagtttagtgaactttcatgtgtttgaaataaaaatgaaaggtgggatggaaattcattaatccctagatttttctctcctttattgcttgcaaatgttttcttggaagctcttttctctctattagttctatattgcctatgcacgcatgtacacagctgtgtttatttaaaaaaaaaaaaaggcaacatctggtggcaatttgaccctcattagcacaacattgttctattcattcaattaaatattgctataaagttaacttgtgactagccactcacacatgccgagggcaattaatggcatattcctaggagaaccaagtgtgggggtttttcctgtgggagggagggcttagtgggtgatattttgtgggttagcaaacatcttatatttatttgcaaagctgatgtaagtgccatttttttttagcaaagtatatttcactatatttttttcattgtaatggctgacaaaatcaagatggtagactgtatggt

SEQ ID NO: 430460 - DNA, 1340 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacggtaaagacgtgctgtgggagttgggatctgcctttttcatccagagctctgatgcctgtgaacactgaaagagaaagcctaatgtaaagtagtgatgggatttctaaaaataagatatttatgaaaatttgacaacatgggtcatatttctgagcaaggtcttaccagaaaaattgtcatatcaagatagaactccaagtccaatcaatccagactgatatatttctgtacagagtaagaacaactagcaaggttctttcacttggaattactaagatcggagttttgcagaggttgattaaagcaaccatacccaagaaatagctagcatcaagaatgagatttatccaatgttgggtcaagaacattgcttcgacatggaaattaacatggaacattgcttttcgtgatactgttaatttcatactatgttgaaactagttgagtagacatagttaagagataaacataattcttcacgatagtagttttctattaagaaaaatgtcctgctgggcacagtggcatgtacctgttgtctcagctatgtgggaagatcacttgaggccaggagttcaaggctatagtgtgctatgatcatgcctgtgaatagccactgcacttgagcctcttgggaaacataacaagaccccatctgtaaataaaaaaaaaaaaaagaaaaggaaaaaagaaagatgtccccaaagtaatagtttgcaccaaaaatgtaggtaggtagatcctagtggccaggctactcttttgaaatatatgttgctgccagatgcagtggctcatgcctgtactcccaaagtgcctggatgacaggtgtgagcccccgcgcccagccgcatcttcataatttttaagttcacactcaaagacagaactaccaaatttagaagctacatcattaaatatcaaaaaa

SEQ ID NO: 430461 - DNA, 507 bp, Homo sapiens
gtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtaggaaacaccgacaggtgctgtcgccaggaagtctgtatggggaacgattagtgggcggcagatcggaggacgtggagaggccggaggagactgtcgggcatgtgctcaggcagttcagagtgagtctcaattggtactttgataatctcggctagtatatataagcattaataacatatatgatgcttgtcttttctgtctttac

SEQ ID NO: 430462 - DNA, 1363 bp, Homo sapiens
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggtgagtgaattattgtaaggcaaacccttgtaaccctacccacatcctgctggagaggagactggaagtaggatcactccatctagattctgggagaagaccctgctccaaaggaccttgatgaggtttcatggtttggtaacctcatgcactgtgggaatgtcagaggaccccgagataatgcttcactgccaagtctgaaaattgtgtccacaagatttgattggtagtattttctatcattgtacaacttaaaatatcttctaatttccatttttttttttgacatgagttgtatagaaatgtgtgcttcagtttctgttatagcaacaactcttgtcacccatagccttacaaaaattcctaattttaatatttaaattttagaaactttcttacaagcagaattacaaaaagagtaactaacaagaaagtgagattgtgatgggataacggaatgtcaagtctaattgtcaggaaaagacaaaataacatgggaatgacaatcaaaatggactaaggacttagaagatccgaaactatgaagctactaaaagaaacattggggaatgctccaggacattggtctgggcaaagatttcttgagcaataccttaaaaggacaggcaacccaagcaaaaatggacagatgggatcacatcaagctaaaaaacttctacacagcgaaggaaacaaagtgaacagaataacatgggaatgttttctgtaatttagtagtaactggcaatagtttacaaacacattttgtgtatactgctgtcattgcactgattaccttctgttgtagtgactttgttctattagtccactcaattaaaatatttggttttgtttatctttgtattcctgggcctggcagtactcaccacttaataggtgctcaaaaactttattaaatgatgagttgaagccctgaaacatttaaacaaaatgcagaagactgataattttataaatgcattgatcagaaaggggaaactatggtattgtaggcacattatggattttgcttcgtaattataaataatattctaggtatcaatttc

SEQ ID NO: 430463 - DNA, 3253 bp, Homo sapiens
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatata

SEQ ID NO: 430464 - DNA, 864 bp, Homo sapiens
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcaggtgagagcttcctagtcctacgcgactgacttcacaagttttcttctgacaaacggtgtggtctttctctcaacgttagtagacgggcccaagaatttaatactgtgtttattgctgagacctcgcatgtatattcgacgttaatttctcatttccctgctacctcgcctctccgtacggcccgtcttcctgacgccagtcttacggccctcggccctgcactctcttcctcctccgtcctccggcctcttcttccgccccctcccttctctct

SEQ ID NO: 430465 - DNA, 5947 bp, Homo sapiens
  misc_feature (4332)..(4332): n is a, c, g, or t
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaaaaaaactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccaatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcanggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttccttcctgcttccgcttcctgttcaggaacagggccgcattttcccatcctcttcggctgtaggcgtggtcacgtgaccaggagggcggggcgcgcctgcctagcataagctggaggacggcgccctcaccctggcgggaggtggatccccagcgcggtgcagttacatcgcagacatgggctcgtctatacgctgctggacggccggggtctgggctccacagccggggggcaccaccctggagctggtgataggggagggaatcgccgctcgggcgcccgggcctcgcgcggagcctgcgtgcgcgggagttcacggggcaaatcctgcccatcctccgcgctcaggcgtggcttcaaaagcctcgggccgggtggtgcagccccagcataacctggcgccccggtggctgctggagtggttggctcagaatggaaggaaacggtggggtctgcgttactctgtggtgataaaaaagagaagcggcagcttagcgccaagaataaatgatgaccgccggaatccctgccgttaggcgcaggtcttggcatgagagctgcaacagggcggccagctgggcgccagggggcctgggccgcctgtccggtgcgggtccccgaatatcctgggctcttccgggaagtgccgctgcggtgaggccagagcctcccgctacggaggatgcgatgtgatgtgct

SEQ ID NO: 430466 - DNA, 6003 bp, Homo sapiens
  misc_feature (4388)..(4388): n is a, c, g, or t
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggtgaccgcaaaggtctaatgaacgaaagctaaaacaaaccttggaagcagaaatgggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaaaaaaactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccaatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcanggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttccttcctgcttccgcttcctgttcaggaacagggccgcattttcccatcctcttcggctgtaggcgtggtcacgtgaccaggagggcggggcgcgcctgcctagcataagctggaggacggcgccctcaccctggcgggaggtggatccccagcgcggtgcagttacatcgcagacatgggctcgtctatacgctgctggacggccggggtctgggctccacagccggggggcaccaccctggagctggtgataggggagggaatcgccgctcgggcgcccgggcctcgcgcggagcctgcgtgcgcgggagttcacggggcaaatcctgcccatcctccgcgctcaggcgtggcttcaaaagcctcgggccgggtggtgcagccccagcataacctggcgccccggtggctgctggagtggttggctcagaatggaaggaaacggtggggtctgcgttactctgtggtgataaaaaagagaagcggcagcttagcgccaagaataaatgatgaccgccggaatccctgccgttaggcgcaggtcttggcatgagagctgcaacagggcggccagctgggcgccagggggcctgggccgcctgtccggtgcgggtccccgaatatcctgggctcttccgggaagtgccgctgcggtgaggccagagcctcccgctacggaggatgcgatgtgatgtgct

SEQ ID NO: 430467 - DNA, 5786 bp, Homo sapiens
  misc_feature (4171)..(4171): n is a, c, g, or t
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgactgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaaaaaaactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccaatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcanggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttccttcctgcttccgcttcctgttcaggaacagggccgcattttcccatcctcttcggctgtaggcgtggtcacgtgaccaggagggcggggcgcgcctgcctagcataagctggaggacggcgccctcaccctggcgggaggtggatccccagcgcggtgcagttacatcgcagacatgggctcgtctatacgctgctggacggccggggtctgggctccacagccggggggcaccaccctggagctggtgataggggagggaatcgccgctcgggcgcccgggcctcgcgcggagcctgcgtgcgcgggagttcacggggcaaatcctgcccatcctccgcgctcaggcgtggcttcaaaagcctcgggccgggtggtgcagccccagcataacctggcgccccggtggctgctggagtggttggctcagaatggaaggaaacggtggggtctgcgttactctgtggtgataaaaaagagaagcggcagcttagcgccaagaataaatgatgaccgccggaatccctgccgttaggcgcaggtcttggcatgagagctgcaacagggcggccagctgggcgccagggggcctgggccgcctgtccggtgcgggtccccgaatatcctgggctcttccgggaagtgccgctgcggtgaggccagagcctcccgctacggaggatgcgatgtgatgtgct

SEQ ID NO: 430468 - DNA, 5866 bp, Homo sapiens
  misc_feature (4251)..(4251): n is a, c, g, or t
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaaaaaaactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccaatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcanggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttccttcctgcttccgcttcctgttcaggaacagggccgcattttcccatcctcttcggctgtaggcgtggtcacgtgaccaggagggcggggcgcgcctgcctagcataagctggaggacggcgccctcaccctggcgggaggtggatccccagcgcggtgcagttacatcgcagacatgggctcgtctatacgctgctggacggccggggtctgggctccacagccggggggcaccaccctggagctggtgataggggagggaatcgccgctcgggcgcccgggcctcgcgcggagcctgcgtgcgcgggagttcacggggcaaatcctgcccatcctccgcgctcaggcgtggcttcaaaagcctcgggccgggtggtgcagccccagcataacctggcgccccggtggctgctggagtggttggctcagaatggaaggaaacggtggggtctgcgttactctgtggtgataaaaaagagaagcggcagcttagcgccaagaataaatgatgaccgccggaatccctgccgttaggcgcaggtcttggcatgagagctgcaacagggcggccagctgggcgccagggggcctgggccgcctgtccggtgcgggtccccgaatatcctgggctcttccgggaagtgccgctgcggtgaggccagagcctcccgctacggaggatgcgatgtgatgtgct

SEQ ID NO: 430469 - DNA, 5572 bp, Homo sapiens
  misc_feature (3957)..(3957): n is a, c, g, or t
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccgggcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaaaaaaactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccaatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcanggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttccttcctgcttccgcttcctgttcaggaacagggccgcattttcccatcctcttcggctgtaggcgtggtcacgtgaccaggagggcggggcgcgcctgcctagcataagctggaggacggcgccctcaccctggcgggaggtggatccccagcgcggtgcagttacatcgcagacatgggctcgtctatacgctgctggacggccggggtctgggctccacagccggggggcaccaccctggagctggtgataggggagggaatcgccgctcgggcgcccgggcctcgcgcggagcctgcgtgcgcgggagttcacggggcaaatcctgcccatcctccgcgctcaggcgtggcttcaaaagcctcgggccgggtggtgcagccccagcataacctggcgccccggtggctgctggagtggttggctcagaatggaaggaaacggtggggtctgcgttactctgtggtgataaaaaagagaagcggcagcttagcgccaagaataaatgatgaccgccggaatccctgccgttaggcgcaggtcttggcatgagagctgcaacagggcggccagctgggcgccagggggcctgggccgcctgtccggtgcgggtccccgaatatcctgggctcttccgggaagtgccgctgcggtgaggccagagcctcccgctacggaggatgcgatgtgatgtgct

SEQ ID NO: 430470 - DNA, 4929 bp, Homo sapiens
  misc_feature (3314)..(3314): n is a, c, g, or t
attttctgatgtcgtatgacatttccaggagatacccaatctttactcccattgccaaacgcccaatcgcccgatacaactctccaggtagagattcatttggacaatccctatgcaccactcccgtaccagcttggaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaaaaaaactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccaatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcanggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttccttcctgcttccgcttcctgttcaggaacagggccgcattttcccatcctcttcggctgtaggcgtggtcacgtgaccaggagggcggggcgcgcctgcctagcataagctggaggacggcgccctcaccctggcgggaggtggatccccagcgcggtgcagttacatcgcagacatgggctcgtctatacgctgctggacggccggggtctgggctccacagccggggggcaccaccctggagctggtgataggggagggaatcgccgctcgggcgcccgggcctcgcgcggagcctgcgtgcgcgggagttcacggggcaaatcctgcccatcctccgcgctcaggcgtggcttcaaaagcctcgggccgggtggtgcagccccagcataacctggcgccccggtggctgctggagtggttggctcagaatggaaggaaacggtggggtctgcgttactctgtggtgataaaaaagagaagcggcagcttagcgccaagaataaatgatgaccgccggaatccctgccgttaggcgcaggtcttggcatgagagctgcaacagggcggccagctgggcgccagggggcctgggccgcctgtccggtgcgggtccccgaatatcctgggctcttccgggaagtgccgctgcggtgaggccagagcctcccgctacggaggatgcgatgtgatgtgct

SEQ ID NO: 430471 - DNA, 4414 bp, Homo sapiens
  misc_feature (2799)..(2799): n is a, c, g, or t
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagttgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaaaaaaactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccaatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcanggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttccttcctgcttccgcttcctgttcaggaacagggccgcattttcccatcctcttcggctgtaggcgtggtcacgtgaccaggagggcggggcgcgcctgcctagcataagctggaggacggcgccctcaccctggcgggaggtggatccccagcgcggtgcagttacatcgcagacatgggctcgtctatacgctgctggacggccggggtctgggctccacagccggggggcaccaccctggagctggtgataggggagggaatcgccgctcgggcgcccgggcctcgcgcggagcctgcgtgcgcgggagttcacggggcaaatcctgcccatcctccgcgctcaggcgtggcttcaaaagcctcgggccgggtggtgcagccccagcataacctggcgccccggtggctgctggagtggttggctcagaatggaaggaaacggtggggtctgcgttactctgtggtgataaaaaagagaagcggcagcttagcgccaagaataaatgatgaccgccggaatccctgccgttaggcgcaggtcttggcatgagagctgcaacagggcggccagctgggcgccagggggcctgggccgcctgtccggtgcgggtccccgaatatcctgggctcttccgggaagtgccgctgcggtgaggccagagcctcccgctacggaggatgcgatgtgatgtgct

SEQ ID NO: 430472 - DNA, 3095 bp, Homo sapiens
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatata

SEQ ID NO: 430473 - DNA, 3745 bp, Homo sapiens
  misc_feature (2130)..(2130): n is a, c, g, or t
atcacgttttcagtgatcatatttgttaactcctgcgttcatcaagacttaccaaaagaagatgaatttgtttaaagtcaaattggaaaccccatccttttccacatgttgccaagacagatgttcagatatacatagaaaacgtgtgtgctggccaggcacagtggctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaaaaaaactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccaatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcanggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttccttcctgcttccgcttcctgttcaggaacagggccgcattttcccatcctcttcggctgtaggcgtggtcacgtgaccaggagggcggggcgcgcctgcctagcataagctggaggacggcgccctcaccctggcgggaggtggatccccagcgcggtgcagttacatcgcagacatgggctcgtctatacgctgctggacggccggggtctgggctccacagccggggggcaccaccctggagctggtgataggggagggaatcgccgctcgggcgcccgggcctcgcgcggagcctgcgtgcgcgggagttcacggggcaaatcctgcccatcctccgcgctcaggcgtggcttcaaaagcctcgggccgggtggtgcagccccagcataacctggcgccccggtggctgctggagtggttggctcagaatggaaggaaacggtggggtctgcgttactctgtggtgataaaaaagagaagcggcagcttagcgccaagaataaatgatgaccgccggaatccctgccgttaggcgcaggtcttggcatgagagctgcaacagggcggccagctgggcgccagggggcctgggccgcctgtccggtgcgggtccccgaatatcctgggctcttccgggaagtgccgctgcggtgaggccagagcctcccgctacggaggatgcgatgtgatgtgct

SEQ ID NO: 430474 - DNA, 1874 bp, Homo sapiens
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggctgaggcaggagaattgcttgaacccaggaggcagagtttgcagtgagccgagatcacgccatcgcactccagcctgagcaacaagagtgaaactccatctca

SEQ ID NO: 430475 - DNA, 1795 bp, Homo sapiens
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgagccaggattgtgcgactgcactccagcctgggtgacagggtgaaacgccatctca

SEQ ID NO: 430476 - DNA, 841 bp, Homo sapiens
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcaggtgagagcttcctagtcctacgcgactgacttcacaagttttcttctgacaaacggtgtggtctttctctcaacgttagtagacgggcccaagaatttaatactgtgtttattgctgagacctcgcatgtatattcgacgttaatttctcatttccctgataaatgcatttgatgtatggccgttatttctgatgggagcctcaggcactcgtgctgtaacttcttttccctctgtttcttctgggctctt

SEQ ID NO: 430477 - DNA, 492 bp, Homo sapiens
agcttcctgcgactgcagtggtggcggcgtgtggtttcgctgcttggtaacagtgagcacaaacccaccctctcttctcttctcagaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagca

SEQ ID NO: 430478 - DNA, 4745 bp, Homo sapiens
gtggcccgagtcgcgcgcaccggcggcggcgggggcagcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactgagaatgaaattgctttggcaagctaaaatgagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcctaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggattgtatctggattattaac

SEQ ID NO: 430479 - DNA, 795 bp, Homo sapiens
ctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcggtatcaaatctattgggagggaggggaacgtgtccgggcaggcgctggggtcgggtggcaaaactggggtgaatttgtagaatttgggaaagggtcattgacatcttaaaataggtggtcgtttggagcaagaatgctcgaaaggggtgagggtaggttaggctgtctagtgctgggggaaaacaaaatgtggaaggattggtggaaaccagacctttaagatttatattatgatttgagatttatatgattccatctaggccagatttaaaaaaatatttgacatccccatttctggaatgtaggagataaaggcactaagacgaaggaaatggtagttgtgctgtgtgtattacactgaagaacaaatatttgcag

SEQ ID NO: 430480 - DNA, 413 bp, Homo sapiens
gagggcctgctcctcagcacctttctcctggtctagatgtgcagtttcctcaagggcagagattttgtccatcttgtccactactatatgccaagtgtttggaacagtttgcacggaggaatggttcctgaatgaattgaatgcatggatgaagtttcttcacctttggccaccttggatactgttttcttagcttggaatgtgttttcctcacttcattcaaaggaccagcttaaacatcacctcctcatagagacctacactgtgcctgtgtcttggtttagctcccttgcctacttttactttaagacacttatcacaatgatgatggtattatttatgtgatcatttatgtaatgactatctctgtcactagattaaagacctcatagggtcagggtctgtgactattt

SEQ ID NO: 430481 - DNA, 583 bp, Homo sapiens
agaagttactgtttttctctttccctcctctattatttgagagttagtcaccaagtctagcccaaggggttatattaatagtgatgccccatgcttttgtggtacatacttctctgtgtacaacagccaatggtgaggcaatgactatccagtgccatccccaactaccaggaatgtccccatgctctgaaagagaacagacatccttctcacttgagccaaagcaaaacataaaccccacagtcaacacttttgaacagatgtgtatgatctcctggctttgaggcttggttttcatgatttcacaagttagatattagatcatggagtttctatcctatttgtgtagaaatttaaaaaatgttattcatggaggttagcaccactggcccgcagttaggccttgaatacatccatttgctccagcttgaagattcctaaaacccctcaacttttcaatgacaataaagacagttttgctttggatgctcttcagggtgtgatgcagggaactgtgccctacctgggcaccttcctgactgacctgaccatgcttgacactgcccttcaggactacatcgag

SEQ ID NO: 430482 - DNA, 793 bp, Homo sapiens
ctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgtgtgcagtttcctcaagggcagagattttgtccatcttgtccactactatatgccaagtgtttggaacagtttgcacggaggaatggttcctgaatgaattgaatgcatggatgaagtttcttcacctttggccaccttggatactgttttcttagcttggaatgtgttttcctcacttcattcaaaggaccagcttaaacatcacctcctcatagagacctacactgtgcctgtgtcttggtttagctcccttgcctacttttactttaagacacttatcacaatgatgatggtattatttatgtgatcatttatgtaatgactatctctgtcactagattaaagacctcatagggtcagggtctgtgactattt

SEQ ID NO: 430483 - DNA, 5121 bp, Homo sapiens
ctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggagagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcctaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggattgtatctggattattaac

SEQ ID NO: 430484 - DNA, 1194 bp, Homo sapiens
acgctgtcgctgcgcacacctggcctctgtgccgcctgctccctgctcgtcctcccctccccaccctcacccacctgccatggacgggcccgccgagccccagatcccgggcttgtgggacacctatgaagatgacatctcggaaatcagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgtggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctg

SEQ ID NO: 430485 - DNA, 1092 bp, Homo sapiens
tagaggatcccctgatttggattctgaagatgacatctcggaaatcagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgtggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctg

SEQ ID NO: 430486 - DNA, 1138 bp, Homo sapiens
ggatccccgatatgtattttttatttcctctttctgatggctaatagaaacctcagagcaaactatggatccctctttctaacacagtacaggatatggtgacttccccttgggacactaaccttactcctggtttgatctttttctagcctatcctctttttctcctccttctcagtcccttttattttatcttgaaaaattgtttatatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgtggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctg

SEQ ID NO: 430487 - DNA, 871 bp, Homo sapiens
agtgctgggattacagacatgagccaccgcagctggccaagtgttctttctcagcctccctccctttatgcctttgtcattccctcaagcaatttccagaacctcctgtgtgtggggctctgggctaaggctctaggaacgtgtaagaccttgcctgtcctcaaggggttcctcaatctgtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgtggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctg

SEQ ID NO: 430488 - DNA, 897 bp, Homo sapiens
acgctgtcgctgcgcacacctggcctctgtgccgcctgctccctgctcgtcctcccctccccaccctcacccacctgccatggacgggcccgccgagccccagatcccgggcttgtgggacacctatgaagatgacatctcggaaatcagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtgcgtgagcccagacccaactccagccccagccccagccccggccaggcctctgagaccccgcacccacgaccctcataataaacacgtcgattctg

SEQ ID NO: 430489 - DNA, 791 bp, Homo sapiens
tagaggatcccctgatttggattctgaagatgacatctcggaaatcagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcgggtctgtggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctg

SEQ ID NO: 430490 - DNA, 375 bp, Homo sapiens
tcatcacctaccccaagtcaggtacctgccgggctgcgggcgtcgggggctggggagagtggggagggggtgcggcagaggacaggaaaggcacatagagaaggaggggaggaggaaaagtggggccgggtctgttcagagcggtgcccctgccagaagtagcctcccagggatacccacccggtgcccagcctctcccctccaggtcagttctcaacacttcaccttccctgacctccctggctgaaatagcgtcctcgttctgttcctccctttcccctttaccctctacttctcttttttttttttttttttgtagagatggggtctcgctacattgcccaggctggtcttgaactcctgatctcaagtgat

SEQ ID NO: 430491 - DNA, 1445 bp, Homo sapiens
ccgtgatctcggctcactgcaacctccgcctcctgggttcaagcgattctcctgcctcagcctccggagtaactgggagtacaggcatgcgccaccacgcttggctgatttttgtctttttagtaggggcggggtttcaccatgttggccaggctggtctcaaactcctgacctcaggtgatccacccacctctgtctcccaaagtgctgggattacaggagtgtgccactgcgcctgaccagctttataaagtttatagggacagtgtcaccactttacagaagagggactgaggctctgaggaggaagttccttgccagggtccgagtgtcgccaccctgagaactccagcacccacctccctactctccctcatggcgtctcccccacctttccacagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgtggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctg

SEQ ID NO: 430492 - DNA, 342 bp, Homo sapiens
gagagagagagagagagagagagagagagagagagagagagagagagagagagagggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430493 - DNA, 601 bp, Homo sapiens
  misc_feature (35)..(35): n is a, c, g, or t
  misc_feature (43)..(43): n is a, c, g, or t
  misc_feature (53)..(53): n is a, c, g, or t
  misc_feature (65)..(65): n is a, c, g, or t
  misc_feature (118)..(118): n is a, c, g, or t
  misc_feature (126)..(126): n is a, c, g, or t
  misc_feature (129)..(129): n is a, c, g, or t
atacgtattgagctcggtacttagggtcgcctgtncaatctgnaaacggccantggagggggagnaaggggtctgaaaatgtcactgaggcgttcgctttactagtgcgacttcgttntcttttcnttntcttttttttgtctgctttaccagatgcgactttcttgtcttttccttttcgtttttgagacggagtcttgctgtgttcgcccaggctggtcttgaactgctgaccttgtgatccaccctcctcggcctcccaaagtgctgggattacaagggtgagccactgtgcctggcctctaattgtgctgttttataagttggactggcatggccttacttaaattttcaggaaactgttgagtcagtaggtagaatattgaatgttaagtttgtccagaggccagatgccagaacttttggacaagtgagttaatgtccacctccagtccttagcacttgctctaagcgctcacaggcaacagggcaaatgcttgcatggcaggtgcacggcagtgccagccaggtctctcgcagggtggtgtggacacagatgactcgtgtcgagcacacgtgttgtggcctgcacgatgagcta

SEQ ID NO: 430494 - DNA, 459 bp, Homo sapiens
cggccgcgtccccgggcggaaggctcacgctcggtgacgccgcgctgtcccagaacctcagcgactttgcagactcactggtgacccaacggtgcgccccgccgccgccgggcggaagtcccgcccctgccccggagaggaagttccgcctcatcgagcgccgattggccgcaccgccttagagaggacgcgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgtaggaaaggggcggggttagcagagccgtgatggacatgcaagcgacccaatggcgccggcgacggggcgggcgagg

SEQ ID NO: 430495 - DNA, 2723 bp, Homo sapiens
tggggcggcgcggcgcggcctggtggtgcgggaagcggcggggcggcggcgaggctgaggtgcgcccgggcgcgggcggggcggggccggcgctgggcttcgggcgcgcccactcggccgccgtggggcggacgcaacgggcgcaggtgcggggcgcgggctctctcacgccgcggcctcacccggcggtgcttcggcaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430496 - DNA, 2904 bp, Homo sapiens
cggccgcgtccccgggcggaaggctcacgctcggtgacgccgcgctgtcccagaacctcagcgactttgcagactcactggtgacccaacggtgcgccccgccgccgccgggcggaagtcccgcccctgccccggagaggaagttccgcctcatcgagcgccgattggccgcaccgccttagagaggacgcgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430497 - DNA, 3036 bp, Homo sapiens
cggccgcgtccccgggcggaaggctcacgctcggtgacgccgcgctgtcccagaacctcagcgactttgcagactcactggtgacccaacggtgcgccccgccgccgccgggcggaagtcccgcccctgccccggagaggaagttccgcctcatcgagcgccgattggccgcaccgccttagagaggacgcgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgattgcagctgagaaggcgcgaagctgctggtccctgaaaagctgccgcctaccctggtctggagcccctgcgagctggcgtagagcaggaaggggttgcatcacggctgagtcctcccctgcgcagcacatgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430498 - DNA, 2892 bp, Homo sapiens
ggaggaacggggtgttcaccatggcaacagctaatgctgccagcgtgtgatgagtgttgcctgccagcaccggtgggcgctttccgctgcccccgtgtagcccccaccaccacctgtgagaaggcagcaccacccccactgtgcagacgagggattgaggctcaggaggcggcagctgtaggggtgggcttggggtccgggaggagccgccctgcaggcctcctgtgaagcagcgggcttcatggctcttcccctgtcctcctcacgtccacctgggcctggggacggctgccacacacctgcttctgctgcaccgcgcacactaagttctcctgagacccaagcctcagaggaccgcctcaggcccgggatgaccctggctggcatctgagaacccatgtggtcaggagattgcagctgagaaggcgcgaagctgctggtccctgaaaagctgccgcctaccctggtctggagcccctgcgagctggcgtagagcaggaaggggttgcatcacggctgagtcctcccctgcgcagcacatgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430499 - DNA, 3163 bp, Homo sapiens
tgtgccccaacctccagggttaacccctgggtgtgcatttgtttattctgaatcttatcatttatcgcccaccagactgacttggccatctctggcctcgaagggtctccctcagcgagaggtgtccttcctgagctgtcgctccatcctgagcaaggccttcgccctgggagcttagtaatgtcaaccttgttctaaacaggacctggggctacacttcagtcttccagatatcgaaagatggttctaagaggctctaaaaaccctaattttcagatggacagtgccctcttctttcagcctcagcctcttgtgtgataggctcttccattacgtgaaggttttgtcagcctaggagtagggtggatcacagctcattggctggatctggttgcagaattgtagggtgggagtggacgttggggagaggcgggcataggggaatgggcctgtgatgtcaccgtttcgcccgacagggctctgagtgtgagcagtgtgctcccctgtgctgctggagagccatgactgtcactgccgagatatttagggcaggtggaaacagcccagagctgagctccaagtaattggtctctaagggatgtggcaaaaagtccccgtggcaaaacctgctctgcctggctgggggagcttcacagaaactgtcctggagggactggcattctgctctgcaagttttaggttggaaaactcagaaatgcccccactcagctctgtcccaggtactcccggggggattcactgatggactggccgagaggacacttagcttccacagctgcacgtcccccggctgccagaaccccgcatctgcctgcccaggaaacttccacaggctgatggctccaggggagggaggggaagcggcatttctgacaccatggaaggcgcccacccccctgctgcagtcctgccaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430500 - DNA, 2847 bp, Homo sapiens
cggccgcgtccccgggcggaaggctcacgctcggtgacgccgcgctgtcccagaacctcagcgactttgcagactcactggtgacccaacggtgcgccccgccgccgccgggcggaagtcccgcccctgccccggagaggaagttccgcctcatcgagcgccgattggccgcaccgccttagagaggacgcgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430501 - DNA, 2435 bp, Homo sapiens
cggctctgcaccctgcactgtcccacggcctacgcctgggcatgctggtcactgtgcacacgacagtcgggcgtggagcccagcaagaccaggagctacggggccacccggaagggctgcactgtagggcctgagccctggggtctgcccaccttgacctccgcccaccttgacctcccacggccctcaccccatcatagtccagacaatgagggcgggccctgctgcggctgaggggtgggtggcaccctgcgtttgtgcgtctgctgagttctgtgcccccagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430502 - DNA, 1793 bp, Homo sapiens
tggggcggcgcggcgcggcctggtggtgcgggaagcggcggggcggcggcgaggctgaggtgcgcccgggcgcgggcggggcggggccggcgctgggcttcgggcgcgcccactcggccgccgtggggcggacgcaacgggcgcaggtgcggggcgcgggctctctcacgccgcggcctcacccggcggtgcttcggcaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430503 - DNA, 1096 bp, Homo sapiens
gctgggtgactgtgcccatgctgaccctgtgcttatggtggtgatgaaggcctggaggagcaggatgagtaggagcatgtggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430504 - DNA, 843 bp, Homo sapiens
gtgctgttttataagttggactggcatggccttacttaaattttcaggaaactgttgagtcagtaggtagaatattgaatgttaagtttgtccagaggccagatgccagaacttttggacaagtgagttaatgtccacctccagtccttagcacttgctctaagcgctcacaggcaacagggcaaatgcttgcatggcaggtgcacggcagtgccagccaggtctctcgcagggtggtgtggacacagatgactcgtgtcgagcacacgtgttgtggcctgcacgatgagctaaattgaacagtgtttcaggaaggaagccacatcggggagctgagaggtgggcgggaaggacacaagggagggatctgggtcctcgcaggtacttttgcctcttgttctatttgaagattgcagctgagaaggcgcgaagctgctggtccctgaaaagctgccgcctaccctggtctggagcccctgcgagctggcgtagagcaggaaggggttgcatcacggctgagtcctcccctgcgcagcacatggtacgatgccaccccaccgagggccgttctggggcccaggggccacgtcagccagggtgtcatccgccgggcgtttggagtaagcagggaaaggtgtcggcgtccagcatcctggtgcggagaacgctgccgaaccactgtgagaaggcggggagactgcttgtcaggctgagctgacttcctgggcggtcgggagaaggatgtgcagactgtggaactggcgggtgtcagggaccagaagttacgaaggcggtgggaagaggagcagctgtgggaagaaggactggctgccaagaccatgg

SEQ ID NO: 430505 - DNA, 2609 bp, Homo sapiens
agcggatttctctgggaggcagccgcagggaagggaatgatcttggtgaacttataatcgaaccaatggttccgggaaagcaggaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430506 - DNA, 2582 bp, Homo sapiens
tggggcggcgcggcgcggcctggtggtgcgggaagcggcggggcggcggcgaggctgaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430507 - DNA, 2782 bp, Homo sapiens
cggccgcgtccccgggcggaaggctcacgctcggtgacgccgcgctgtcccagaacctcagcgactttgcagactcactggtgacccaacggtgcgccccgccgccgccgggcggaagtcccgcccctgccccggagaggaagttccgcctcatcgagcgccgattggccgcaccgccttagagaggacgcgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430508 - DNA, 2244 bp, Homo sapiens
caagtctctgttgcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430509 - DNA, 2872 bp, Homo sapiens
tggggcggcgcggcgcggcctggtggtgcgggaagcggcggggcggcggcgaggctgaggtgcgcccgggcgcgggcggggcggggccggcgctgggcttcgggcgcgcccactcggccgccgtggggcggacgcaacgggcgcaggtgcggggcgcgggctctctcacgccgcggcctcacccggcggtgcttcggcaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcagctctgtcccaggtactcccggggggattcactgatggactggccgagaggacacttagcttccacagctgcacgtcccccggctgccagaaccccgcatctgcctgcccaggaaacttccacaggctgatggctccaggggagggaggggaagcggcatttctgacaccatggaaggcgcccacccccctgctgcagtcctgccaggggatcctcttggtgtatgacatcaccaaccgctggtcctttgacggcatcgaccgctggatcaaggagatcgatgagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggacgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430510 - DNA, 1461 bp, Homo sapiens
tggggcggcgcggcgcggcctggtggtgcgggaagcggcggggcggcggcgaggctgaggtgcgcccgggcgcgggcggggcggggccggcgctgggcttcgggcgcgcccactcggccgccgtggggcggacgcaacgggcgcaggtgcggggcgcgggctctctcacgccgcggcctcacccggcggtgcttcggcaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtc

SEQ ID NO: 430511 - DNA, 1180 bp, Homo sapiens
aacaaaaaggccctttcatctagaagttttaaaaccctctaataaacaactctggggtgaaagcagaaatacaaactggaattacagaaaaaaatgatacaaaatgataatcaaaacactacctatcagaatcaatgttatacatttaaagcagcaatcagaggaaaattcatagcactaaacactttttatcagaaaaaacacgccccacctttttaatctatttccaagtctgagtgtttcttaataattactgctgaaatggcttattcccagccacttctattatgcctctcctttccttgttcccaaatatccccaaccaaggatttttgccttaaaaaatcaaatgtcttcaatgaggttgaagaactatgtgacagctagctctatgtttattgacttaaatactggtagaggattcctgggctctttttcatggtgtaaaatcctcacagtgacgctcttggtgttgctctaatccctaaactcagatatgtacatatatatgtccagtggtccgaggtgaattggatggagaataatttcccagcataaaatctttcaaatgtctttatggtggcatgtagaaaaccatttccacaacataatctgaagctgtactatctattgctgtgtaactaattacccaaaatcttagtgacttcaaaccgcaaacattcatacctcacattttctgtgggtcagagatctaaacgcagtttagctgagagcctcaagctcaaggtcactatgagatttgggaggagttggtggccagggtcatagtctcatctgaaggcttgactggtgaggaatccacttacaaactaacttggcaggtctcggtccattgtcaaatggttctcttcacaggggtggccttaggacatggcagatggcttcctcacatggcaaattaaacaggagagagcaagagagatggaagtcacagtctttttataacctactcttgaatggtaccccatcacttctgctatattctattcgttagaagccagtcaataagtctagcctcaggagcaattactcaaaggtgtgaatatcaggctgtggcttacactgggaacatcttagggagcgcaacatagaaaaacagctcagtcacaaactcaacaacctgcagggccaaacagaaataaaatgagtgagtgggcct

SEQ ID NO: 430512 - DNA, 701 bp, Homo sapiens
aacaaaaaggccctttcatctagaagttttaaaaccctctaataaacaactctggggtgaaagcagaaatacaaactggaattacagaaaaaaatgatacaaaatgataatcaaaacactacctatcagaatcaatgttatacatttaaagcagcaatcagaggaaaattcatagcactaaacactttttatcagaaaaaacacgccccacctttttaatctatttccaagtctgagtgtttcttaataattactgctgaaatggcttattcccagccacttctattatgcctctcctttccttgttcccaaatatccccaaccaaggatttttgccttaaaaaatcaaatgtcttcaatgaggttgaagaactatgtgacagctagctctatgtttattgacttaaatactggtagaggattcctgggctctttttcatggtgtaaaatcctcacagtgacgctcttggtgttgctctaatccctaaactcagatatgtacatatatatgtccagtggtccgaggtgaattggatggagaataatttcccagcctgttggctatttttggatgcacacacatgcctctcaccatttgttcctaacatttccaggagctcaagtcagcgcccccaaggcatgactttctaggcacctcatgagcctctagttacagatagttccttttcatattttctttt

SEQ ID NO: 430513 - DNA, 944 bp, Homo sapiens
agaagaggaagaatgaaggaagcagaataaacattgaaaaagaaaaggcccaattcttcctaaattccaaagcctctgtcgtaatactacaaaatgtttctgagagaaattaaggaagacttaaataaagtatatactatgtttatggattggaagatgttatcgttaagatggcagttctccccaaattacactgtagactcaatgcagtgtctaccatgatcccagcagacatttttaaaaaaattgacaagacggttgtaaagtttacatggagatgcagaggaccttggaatggcttaatcagtcttgtagaagaacaaagctagatttacattacgtgatttcaagagtttctatgaaatgtatcaagacacagaagtgttagtgtaaagatagacaaatagatggatggaatagagtagttattccaaaatagactcacccttatttggtcaattggtttctgacagagatccaagcaatccaatggtaaggtttttgtttggtttgtttgttttctaagagtcagggtctcactctgtcgcccaggttggagtgcagtggcacgatcataacttattgcagcctcaaactcctggactccagcaatcctccttcctcagcctccttagtagctgggacgacaggcatgagccaccatgccctgctcgaaaaagaggcgttttgagaaattgttctggaacatgtggatattcctatgggaaaaaagtgaaccctgctacttcataccacgcacataaattaacttgagatgaaatcagagacctaaacagagtggctaaaactatgaagttccgataagaaaatatattgtgattgaaagacagcaaagatttcttagacaaggcacaaggatttcttaggacacaggacagagccaggatgcgactaaggaaaggtgataaattaggctttattaa

SEQ ID NO: 430514 - DNA, 4802 bp, Homo sapiens
tcagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggaggtgaggtctcataattcactgcaacctacaattcctggccttaaatgatcctgctgcttcagccttctaaagtgctgggcttacagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgatactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacatt

SEQ ID NO: 430515 - DNA, 3256 bp, Homo sapiens
cccaagtgtatcccccccctggcgctctttagggggcccccccatagcctttccccccaaaaaaaaaaaaaaaaaaaaaaaaaaaaaaaggagagagagattgataattttgagttatccacgctctgtccttactgttacaagttgactggttgaatgacttctttcttggcataatagccatcccaagtgtgggtttgtgggaatcctgaagtgagaaagttctgacattggctctttctgggtgccagcattattatagtcttgtaatctatagttttcactcttccttcccaatactggagcaacattcagaggcccattccccaggaaaaccctccctttcctttgcccacagttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacatt

SEQ ID NO: 430516 - DNA, 2756 bp, Homo sapiens
tcagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgatactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactgtgagtaatgatcctcgagtgagaacatgggattttaagtcagttctccagcaagatgtgtcatttggtctctgtgatgctccctctaggagagggggtctgactgaaccaattctccttttagtctacctgggaaagaatataatgacaagggaattttgctaactactagactcttgattatatacatgtatgttgttcttattaacattttccttgaaacttctttttgtttgagggggttcttgctccatcacccaagccagagtgcagtggtgaaattacagctcacagcagccttgaccttctaggctcaagcagtccttcgtctaagcctcctgagtagctgggacataccaacacacccagctaattattttatttgtagagacagggtcttaccacattgctcaggttgttctggaacttctgggctcaagcaattttcctgccttgggcctcccagtgctggaattataggtgtgagccagcatgcctggcccctggaaaacttttgatgacttcccctactgtcatttggtgtgtccttaaagattgtcaactagttttaaactactttgtgtacaaataattacctttttcataaatttgtttcaaaagatttttcattttaagagattgatcattttgaggctgggtgcagtggctcacgcttataatcccagcactttgggaggccacggcaggtggatcatctgaggtcaggagtttgagaccagcctggccaacatgatgaaaccctgtctctattaaaaatacaaaaattaggcatggtggcgggcacctgtagtcacggttactgcagaggctgaggcaggaaaattgcttgaacctgggaggcggaggttgcagtaagcccagattgtgccactgcactccagcctgggcaatagagcaagactgcaagactctgtctc

SEQ ID NO: 430517 - DNA, 2671 bp, Homo sapiens
  misc_feature (65)..(65): n is a, c, g, or t
ccggacttggatccgcctgcttggcctccccaaatgctgggattactggcatgagccaccgcacncggcctattattattttttgagagacagtttcaccctgttgcccaggctggagtacagtggcacaatctcagctcagtgcaacctccgcctccaggttcaagtgattctcctgcctccgcctcctgagtagctgggattacaggcacatgccaccacacccaactaatttttgtatttttagtagagacggggtttcaccgtgttggtcaggctcatcctgaactcctgacctcaagtgatctgcccacttcagcctcccaaagtgctgggattacaggcgtgagccactgtgccaagcctctttttcccaaattctgacatatgctggatcagagtgttcttgtttccaataggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacattaaattgaatcacctgaccatactttaaatgccttaaaaaatagtaataggctgggcttggtggctcactcctgtagtcccagcactttgggaggctgaggtgggtggatcacaaggccaggagtttcagactggcctggccgacgtggtaaaaccccatctatattaaaaataacaaaaattagccaggcatggtggcggacacctgtaatccctgctgcttgggaggcagaggcaggagaattgcttgagcccgagagacagaggttgcagtgagccgagatcacgtcattgctctccagcctgggcaacagagcaaggctctgtctc

SEQ ID NO: 430518 - DNA, 2533 bp, Homo sapiens
tcagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgatactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactggtaggagacagatgtgtcagctttaagtttttacttgcggtgagaggtggtgggaatcttatcccatagataactaaggatacttgcctaggaatggaggacacaggacatttgtaatttcttccttctctcttttatcctccctttgtactcattatccaagttctagaattacatgataatctctgggcctgggtaaagtgtggaggcagtggacagtataggaatatgggaggtaga

SEQ ID NO: 430519 - DNA, 4716 bp, Homo sapiens
tcagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgatactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacatt

SEQ ID NO: 430520 - DNA, 5045 bp, Homo sapiens
tcagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgatactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacattaaattgaatcacctgaccatactttaaatgccttaaaaaatagtaataggctgggcttggtggctcactcctgtagtcccagcactttgggaggctgaggtgggtggatcacaaggccaggagtttcagactggcctggccgacgtggtaaaaccccatctatattaaaaataacaaaaattagccaggcatggtggcggacacctgtaatccctgctgcttgggaggcagaggcaggagaattgcttgagcccgagagacagaggttgcagtgagccgagatcacgtcattgctctccagcctgggcaacagagcaaggctctgtctc

SEQ ID NO: 430521 - DNA, 4834 bp, Homo sapiens
tcagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgatactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacattaaattgaatcacctgaccatactttaaatgccttaaaaaatagtaataggctgggcttggtggctcactcctgtagtcccagcactttgggaggctgaggtgggtggatcacaaggccaggagtttcagactggcctggccgacgtggtaaaaccccatctatattaaaaataacaaaaattagccaggcatggtggcggacacctgtaatccctgctgcttgggaggcagaggcaggagaattgcttgagcccgagagacagaggttgcagtgagccgagatcacgtcattgctctccagcctgggcaacagagcaaggctctgtctc

SEQ ID NO: 430522 - DNA, 2620 bp, Homo sapiens
tcagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgatactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactggtaggagacagatgtgtcagctttaagtttttacttgcggtgagaggtggtgggaatcttatcccatagataactaaggatacttgcctaggaatggaggacacaggacatttgtaatttcttccttctctcttttatcctccctttgtactcattatccaagttctagaattacatgataatctctgggcctgggtaaagtgtggaggcagtggacagtataggaatatgggaggtaga

SEQ ID NO: 430523 - DNA, 1867 bp, Homo sapiens
aaataaataaagaagaatttatttttccttttcaggtcatgaggctagttaatgattagtgaaatccacgtgggtgttttctgagaggctgggttatatgatctctttggctttagggaattactccacgagcggcacgaggatttccagctcagcgatgcccccaggtccctgggagagctgcttctgggtggggggcctcattttgtggctcagcgttggaagttcaggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcagggttttaggaacaaagccttcctggattgacacatttattagaacccttctgcgtgcaacgaatgctaatgtgattgccgtggactggatttatgggtctacaggagtctacttctcagctgtgaaaaatgtgattaagttgagcctcgagatctcccttttcctcaataaactcctggtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagta

SEQ ID NO: 430524 - DNA, 372 bp, Homo sapiens
ctctactttgggttctcagaagttctcagaagactccttctcactatggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcaggtgggagttaaataaccaacaggacttctcaactaagaatgatcaagtaaccataataccataagaagttagtgggcaacaaggagaggaatgaatttaccaatggccacatgttccatccc

SEQ ID NO: 430525 - DNA, 259 bp, Homo sapiens
aaataaataaagaagaatttatttttccttttcaggtcatgaggctagttaatgattagtgaaatccacgtgggtgttttctgagaggctgggttatatgatctctttggctttagggaattactccacgagcggcacgaggatttccagctcagcgatgcccccaggtccctgggagagctgcttctgggtggggggcctcattttgtggctcagcgttggaagttcaggtaagccagggctcaggccttgggaggaa

SEQ ID NO: 430526 - DNA, 1287 bp, Homo sapiens
aaataaataaagaagaatttatttttccttttcaggtcatgaggctagttaatgattagtgaaatccacgtgggtgttttctgagaggctgggttatatgatctctttggctttagggaattactccacgagcggcacgaggatttccagctcagcgatgcccccaggtccctgggagagctgcttctgggtggggggcctcattttgtggctcagcgttggaagttcaggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcagggttttaggaacaaagccttcctggattgacacatttattagaacccttctgcgtgcaacgaatgctaatgtgattgccgtggactggatttatgggtctacaggagtctacttctcagctgtgaaaaatgtgattaagttgagcctcgagatctcccttttcctcaataaactcctggtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcaatgcattccagcttctcactgttgctcctaaccgtggcatttccttgaagctaggatgctggtgattgtaacgatgttaaatgtgaaataaaaatgtgtccagaatccatgaaataca

SEQ ID NO: 430527 - DNA, 1765 bp, Homo sapiens
aaataaataaagaagaatttatttttccttttcaggtcatgaggctagttaatgattagtgaaatccacgtgggtgttttctgagaggctgggttatatgatctctttggctttagggaattactccacgagcggcacgaggatttccagctcagcgatgcccccaggtccctgggagagctgcttctgggtggggggcctcattttgtggctcagcgttggaagttcaggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcagggttttaggaacaaagccttcctggattgacacatttattagaacccttctgcgtgcaacgaatgctaatgtgattgccgtggactggatttatgggtctacaggagtctacttctcagctgtgaaaaatgtgattaagttgagcctcgagatctcccttttcctcaataaactcctggtgctgggtgtgtcggaatcctcaatccacatcattggtgttagcctgggggcccacgttgggggcatggtgggacagctcttcggaggccagctgggacagatcacagatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagta

SEQ ID NO: 430528 - DNA, 1814 bp, Homo sapiens
aaataaataaagaagaatttatttttccttttcaggtcatgaggctagttaatgattagtgaaatccacgtgggtgttttctgagaggctgggttatatgatctctttggctttagggaattactccacgagcggcacgaggatttccagctcagcgatgcccccaggtccctgggagagctgcttctgggtggggggcctcattttgtggctcagcgttggaagttcaggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcagggttttaggaacaaagccttcctggattgacacatttattagaacccttctgcgtgcaacgaatgctaatgtgattgccgtggactggatttatgggtctacaggagtctacttctcagctgtgagtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagta

SEQ ID NO: 430529 - DNA, 563 bp, Homo sapiens
gtgcagtggcgcgatcttggcttactgcaacctctgtctcccgggttcacgccattcttctgcctcagcctcccgagtcgctggaactacaggcgcccgccactacgcccagctgattttttgtgtttttagtagagacggggttgcaccatgttagccaggatgatctcgatctcctgacctcgtgatccgcctgcctcggcctcccaaagtgctgggattacaggcgtgagtcaccgcgcccagcctcaagctcatcttagagccagagaaactgggtcattgagaggttacctctagagagacaacagagagtggggtttcctgaggaaggtggtcctcagctaattctcccaacccttgggtcttttctgggagggtctatgatctgcactggaagggtgggtgtgtggtgggtccatgaatgttcctgcagctgagaggaaagaggtccctcatatcagtctcttctcacaggcctggaccccgctggacctgagtacaccagggccagtgtggaagagcgcttggatgctggagatgccctcttcgtggaagccatc

SEQ ID NO: 430530 - DNA, 540 bp, Homo sapiens
gggggaaatgcatgagctcagctctgccagggcaccaccagaggagtccagcccagtgtggtagcctgggtgggagtgaatgataagagcaaaggcatcaccggaggtgtggcaacagcccctggtctgaaccaaaactttcagagtgagtccaaccgattgctcttcagatgaggacttgggggcttcttactgtctatctactgatcgtatttcctcttaccctcaaaatttaccctctagtgggtcttctctctcgagtgatgtttaggagtgtcctccggctgcctcctttctgcactctcatttcccacttcttggcgcccaccctatgtggttctcaccctggcagcctccaaggttggggtccctggggaatactgaacctttccctctggtctccttccccttcacagatgcattccagcttctcactgttgctcctaaccgtggcatttccttgaagctaggatgctggtgattgtaacgatgttaaatgtgaaataaaaatgtgtccagaatccatgaaatacattacaa

SEQ ID NO: 430531 - DNA, 2042 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430532 - DNA, 1809 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttat

SEQ ID NO: 430533 - DNA, 744 bp, Homo sapiens
acaagcataagtcatttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagctgccttaaattgggagacttcaagccgggaggttcctttttcccttatttt

SEQ ID NO: 430534 - DNA, 729 bp, Homo sapiens
acaagcataagtcatttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagcttaaatagtggagattccaacccgggttttcttttt

SEQ ID NO: 430535 - DNA, 286 bp, Homo sapiens
tgaaaatgatttggacccatttggaaaaccaacaacctgtaatgtcaggtaatccaggtccatgacctgaatttgaagaaaaaaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430536 - DNA, 537 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaagtaaagagtcttctcccactaccttttacatacacctcatttactcatttaaaaaatcctcagtaatctcttactttctgccctctactccatcaaaatggattaattacctttagaatattaccataggaacatatttattctcctttctttaggttgaagaaaaatagattagggaaagacatt

SEQ ID NO: 430537 - DNA, 3412 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgcaatggcgcgatcttggctcactgcaacctccgcctcccgggttcaagcgattctcctgcctcagcctcccaagtagctgtgattccaggcacgtgccaccacaccagctaattttttgtattttaatagaaacagggtttcaccgtgttagccaggctggtctcaaactgacctcagatgatccgcccgccttggcctcccaaagtgctgggattacagatgtgagccaccgcgcccggccagagcactgttttttttaatggccttgcactcttcttatggacctttgctgccctcagttgaccaaacatgacatcagaaacagatacatttgtgtgttttaaaaacagctcctaatactggaacaaaaatatttaactgtcttgacaatactcatgagtatctgcatggcgacttcagagttgagtttaatcaaagagtttattcttaggtcctagtagaagagctaacctcacactcatcccattctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430538 - DNA, 3358 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgcaatggcgcgatcttggctcactgcaacctccgcctcccgggttcaagcgattctcctgcctcagcctcccaagtagctgtgattccaggcacgtgccaccacaccagctaattttttgtattttaatagaaacagggtttcaccgtgttagccaggctggtctcaaactgacctcagatgatccgcccgccttggcctcccaaagtgctgggattacagatgtgagccaccgcgcccggccagagcactgttttttttaatggccttgcactcttcttatggacctttgctgccctcagttgaccaaacatgacatcagaaacagatacatttgtgtgttttaaaaacagctcctaatactggaacaaaaatatttaactgtcttgacaatactcatgagtatctgcatggcgacttcagagttgagtttaatcaaagagtttattcttaggtcctagtagaagagctaacctcacactcatcccattctaaactatgtgattcaacactgattttacatccaacaaagtgaaatcttgatagttgggtgtataattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430539 - DNA, 2371 bp, Homo sapiens
agcggaagggacgtgagcgggttccggttgtctggagcccagcggcgggtgtgagagtccgtaaggagcagcttccaggatcctgagatccggagcagccggggtcggagcgggtaggtaaactaactcagggaattggggaccgaagcctgaggctgtcctcagagcttggcgtcttccggagctctcccacttaggcattgcggatctggggcactgtgattccgacttccagcagtgttttaggacgctgctgactggatgtctcaccctggatgtctcacgctggcggtagccaggttatttgggacaccttctcatggttggtcacccggacattgaacccagacaccgggctgttcgttctcctctccgcgtacttggaagccttgctaggcttctttagagaacctcttagtcccgggatgtccaggaccttggactcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430540 - DNA, 2010 bp, Homo sapiens
  misc_feature (15)..(15): n is a, c, g, or t
  misc_feature (35)..(35): n is a, c, g, or t
  misc_feature (57)..(57): n is a, c, g, or t
gcttccaggatcctnagatccggagcagccggggncggagcggtttgtaatgtattnctggattttattttgctgtattagctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430541 - DNA, 2081 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattgggctggaggacaatggcgcactgcaacctccacctcccagtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430542 - DNA, 1700 bp, Homo sapiens
tcagaggattcccttattcgtgttgcacattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430543 - DNA, 1951 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaatatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430544 - DNA, 2764 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaattgtgtccgttttcttgagcgttttgattttttacttttagcttataccagctgaatggcagccttgcctaatccacctacaacaagaatttcttaagctttcttttatttgcatgagagagccactaccaaggcatgttttgttatgctgaaactgggctgctgcatactgctaaatggcacctctgggattggcctacctggggatttcttggtttgtgaaaacaggagaggagaaatatctcatacaagtgaaaggatactggagagagaaattacccatttctaaaaaaaaaccacactctgtcgtatctgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaaca

SEQ ID NO: 430545 - DNA, 2169 bp, Homo sapiens
agcggaagggacgtgagcgggttccggttgtctggagcccagcggcgggtgtgagagtccgtaaggagcagcttccaggatcctgagatccggagcagccggggtcggagcgggtaggtaaactaactcagggaattggggaccgaagcctgaggctgtcctcagagcttggcgtcttccggagctctcccacttaggcattgcggatctggggcactgtgattccgacttccagcagtgttttaggacgctgctgactggatgtctcaccctggatgtctcacgctggcggtagccaggttatttgggacaccttctcatggttggtcacccggacattgaacccagacaccgggctgttcgttctcctctccgcgtacttggaagccttgctaggcttctttagagaacctcttagtcccgggatgtccaggaccttggactcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430546 - DNA, 1438 bp, Homo sapiens
agcggaagggacgtgagcgggttccggttgtctggagcccagcggcgggtgtgagagtccgtaaggagcagcttccaggatcctgagatccggagcagccggggtcggagcggacccctcttcagtgaatgaaaagaagaggagggagcgggaagaaaggcagaatattgtcctgtggagacagccgctcattaccttgcagtatttttctctggaaatccttgtaatcttgaaggaatggacctcaaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430547 - DNA, 2260 bp, Homo sapiens
  misc_feature (2049)..(2049): n is a, c, g, or t
  misc_feature (2058)..(2058): n is a, c, g, or t
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaaaaaaaanaaacaaaanaaaaaaaacaaaaaacaaaaagagaagacatcaaaaaaagaaagaggacacagaaaaacgaagaagaaaaacacgaagaagagagaactaagaacttacaaagcacaacgacaattagaggggcgggcgcgccgacaaacaaacatacccgaggggaactacactcatcccgacgccccgtttttcaagaggggagaccctc

SEQ ID NO: 430548 - DNA, 1386 bp, Homo sapiens
acaagcataagtcatttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430549 - DNA, 2756 bp, Homo sapiens
acaagcataagtcatttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgcaatggcgcgatcttggctcactgcaacctccgcctcccgggttcaagcgattctcctgcctcagcctcccaagtagctgtgattccaggcacgtgccaccacaccagctaattttttgtattttaatagaaacagggtttcaccgtgttagccaggctggtctcaaactgacctcagatgatccgcccgccttggcctcccaaagtgctgggattacagatgtgagccaccgcgcccggccagagcactgttttttttaatggccttgcactcttcttatggacctttgctgccctcagttgaccaaacatgacatcagaaacagatacatttgtgtgttttaaaaacagctcctaatactggaacaaaaatatttaactgtcttgacaatactcatgagtatctgcatggcgacttcagagttgagtttaatcaaagagtttattcttaggtcctagtagaagagctaacctcacactcatcccattctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430550 - DNA, 2702 bp, Homo sapiens
acaagcataagtcatttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaacttcctatccaatccctgccttttgagtccaggtggtaagtacattttctttaacgtttttcctgcttttcttcccaaatgtgtctttttctttgggctactgtaccctgcttccagtgctgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgcaatggcgcgatcttggctcactgcaacctccgcctcccgggttcaagcgattctcctgcctcagcctcccaagtagctgtgattccaggcacgtgccaccacaccagctaattttttgtattttaatagaaacagggtttcaccgtgttagccaggctggtctcaaactgacctcagatgatccgcccgccttggcctcccaaagtgctgggattacagatgtgagccaccgcgcccggccagagcactgttttttttaatggccttgcactcttcttatggacctttgctgccctcagttgaccaaacatgacatcagaaacagatacatttgtgtgttttaaaaacagctcctaatactggaacaaaaatatttaactgtcttgacaatactcatgagtatctgcatggcgacttcagagttgagtttaatcaaagagtttattcttaggtcctagtagaagagctaacctcacactcatcccattctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430551 - DNA, 1468 bp, Homo sapiens
atccaggaatcaactgaacgggattaaattcctgcaggtccacttactttatccagttctcatgtgatgggcacacacacatacacacacacagtgccttagccatgagtaatataagctaaaggacaccttggttttctgtgagcagattgtacacctaaggtgaatatgagacccagcttctagacacattaggatgtttgcctaacctccttttgaacaatccagtagtgatcaaggaacccatatattgctttgcagtgtaagcaggctgaaagcagaataccacatatcaatgggtgataaaattaaattgttctttggattataatatggaagtccttctttttctctctatagattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430552 - DNA, 1301 bp, Homo sapiens
acaagcataagtcatttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtgtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430553 - DNA, 1029 bp, Homo sapiens
gatttttaccaaccactcgctttccctgtggccttggcacactggcatgctggtctaggatcctctacgcacaacgcctgctcgcctcctccgtgtggttgccaagccaagccgcctgctaccttcatcaccaaattgcactcgctccttcctggaatcctttttcctagcttcaccaccaaatcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430554 - DNA, 1709 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcagttgaaagacgctgcgtctttcaagcgcg

SEQ ID NO: 430555 - DNA, 1006 bp, Homo sapiens
gcggattacgtaggtttgtggcctgatcagtccactgaaactacaaattgtttaccttctcctcatccgtgggggagacctgcgccacatacgcggtggtggcaacattctcctgggagtggctgaattctcctggggggtggcctaggccaggtggccagcacggcgtgtggcagtgatctcccggccatcaatttgtcctgttgaaaatagacagcaatgctcataccttttctgtgaagcatctaccctagacaatgcatgccacagtgaaagacgcgcgtctttcaactgcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430556 - DNA, 1692 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgtctcaacggcggtctagatactgatggccatttaattgtgttgtttatttagtactgagttataagggttataggaatatttttgtatgtcagttct

SEQ ID NO: 430557 - DNA, 3022 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgcaatggcgcgatcttggctcactgcaacctccgcctcccgggttcaagcgattctcctgcctcagcctcccaagtagctgtgattccaggcacgtgccaccacaccagctaattttttgtattttaatagaaacagggtttcaccgtgttagccaggctggtctcaaactgacctcagatgatccgcccgccttggcctcccaaagtgctgggattacagatgtgagccaccgcgcccggccagagcactgttttttttaatggccttgcactcttcttatggacctttgctgccctcagttgaccaaacatgacatcagaaacagatacatttgtgtgttttaaaaacagctcctaatactggaacaaaaatatttaactgtcttgacaatactcatgagtatctgcatggcgacttcagagttgagtttaatcaaagagtttattcttaggtcctagtagaagagctaacctcacactcatcccattctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagttttctccctgtggtgtgcccatttcgcttttgtggtgaagcttctgccgttgagcctccaggtactcctgaaatggcttctgcagagatggacctatgccggggacagcaccaatgaaagccaccatttgctccactatgtgcttgctgaatgttatgtc

SEQ ID NO: 430558 - DNA, 2964 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgcaatggcgcgatcttggctcactgcaacctccgcctcccgggttcaagcgattctcctgcctcagcctcccaagtagctgtgattccaggcacgtgccaccacaccagctaattttttgtattttaatagaaacagggtttcaccgtgttagccaggctggtctcaaactgacctcagatgatccgcccgccttggcctcccaaagtgctgggattacagatgtgagccaccgcgcccggccagagcactgttttttttaatggccttgcactcttcttatggacctttgctgccctcagttgaccaaacatgacatcagaaacagatacatttgtgtgttttaaaaacagctcctaatactggaacaaaaatatttaactgtcttgacaatactcatgagtatctgcatggcgacttcagagttgagtttaatcaaagagtttattcttaggtcctagtagaagagctaacctcacactcatcccattctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaataggaagaatcagcgggacgaactcccttgcaccggaccatcaaacacgaaactgaagagtagccaactgcccgaacatacctcggcaaggaggacaccgagcaccacgggcaccaggcgaggagccccacgtaaaaggaccttgacatgccgagatcccaaccacgaccgcggcccggccc

SEQ ID NO: 430559 - DNA, 1921 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgagccaagactgtgccactgcactctagcctgggcaacagaacaagactcctcca

SEQ ID NO: 430560 - DNA, 1924 bp, Homo sapiens
agcggaagggacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgagccaaaatcacaccattgctctctaacctgggagacaagagcgaaactccatctca

SEQ ID NO: 430561 - DNA, 864 bp, Homo sapiens
tcgaaagcagcctgcggaggactgatgcaactttcagacacaccagaccagaatgtttgcagcacagcgtgcaaagagtttgggcttcccttcgaagggctgaggaatgactgaaaggagagcgagccccgggctctgctggcacctgtctgtccggctctgaaagaccgcagtgattagcttggagattcacctggcccttttctaaggccatagtgtatcatgtcaaccctcgttcacgtgcaggttttaggtgatgaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaa

SEQ ID NO: 430562 - DNA, 1153 bp, Homo sapiens
acaagcataagtcatttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttat

SEQ ID NO: 430563 - DNA, 917 bp, Homo sapiens
acaagcataagtcatttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtgtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagttttgccattttgtgccggaaatttttttctttgggggaagggaggggtcccccttggaaacaccacctgttttttttagggggaatgtggtgtcaaaaaaaattttaaaaaaaggctttttttggttttttaaagagcccctattaattttatatttcccccccca

SEQ ID NO: 430564 - DNA, 183 bp, Homo sapiens
aagcttaacgaggagtttctgtgatgtgaagaggagtttttgtttttttgttttttggtctgtttttgttcatgtagatgtccccagaatcctgcctttaccactccatatcatacttcttacattgctctttttttctcacagtgctattcaccttctgacattccatataacttacttatt

SEQ ID NO: 430565 - DNA, 4048 bp, Homo sapiens
tttgaagtgctagaatagtttagaaagaaatgttacagatgtatgtttatagttttaatcattgcctcagtgctttcttgtggcagcgtgacaggtataaggagaggggcactggagattgtatttctgatgtcttgaatgtcaagtgtgaaaagtaaccaagattgctttgcagctttgtgagatcaacatcatgaatttgttttcatttcctctggttggaagtttcctaggttagaagctgaggtttcagttactttaaatatggaatttgggaacagggattgaggctttctagcacagtaaatgtgactgaataccctttctaaactaagtggggcacaatgattttttttccttccattttttttttacatgacactttatttctttcacatgttgacatggcttgtattacattctaaatttcatctgtttctgtaactttagctgtgtctataacagatagagcatcagtcaaactagagtggacagggagaaaatgctctactggggaagcactctggaatcttctgattaagtcatttgcaaaagattaatagccataagccttactcttaatggatctgccatttcagtttcaatggcttttgaggaaaaaggagtcatttaaggaaggagataggaagtgtaggccgatccatccacttttcttagtctcccaattttaagagaccctttcttgcacaaaattttttgtaactttccataagtaaagaggaaggtaatggagccgtagaaatgtcaacccatcaaagactagtttgtcgtgtcattacaacaaggcatttagggaacatctttccttaattttactaatagaccaaccaaggaagccttctgaatcgctagtaagattcagctctgggtgattcttcatttctaatggctcatagtgattacagtttatgttaataatcactcctacttctgtcaacctccagcaagagtaaattgatagcaggataaattaaaagtctgatcttaatgtcataaatgtgactagaatatggtactaactttttcgggtctagatagctggaatgaggcttgcaaacagtgttatctggagagagcttgctggtctaacaactttgtgtgataatttggcatctgattagagagcatgagtctgataaattttataatccacacagagatcatgctgtggttggacacatcatttaataatatttagcatgatataatattccattttctctacaggagcacagactctttctcatactggattattttacctttgacagtcatttttcaatgacagtaattttaaataaagcatcgtgtgcttatagaacctgtgcttgagtaaaaatagtcttcaaataaaaataatgaagtaaatttttacttaggccatgcttaattggaagcatagaacttaaattgagaaaaaaatccatatgatagattttgtttttctcatgcttcccttttgaataatagcaaataatgcagagtaatggttctaagagttcagggtagatgaagtctgtaggttttagaagtatagagttgaaaagaacctccaagaggacttatttaatgagtgaaataaatgtccttagatagatattgtccctaaactcttttctattgaaagtttatagtattgaaaatttgatgattattagtacctagtataaatcaacattcatctgatgttctctttttagatagccaagttataacttttttgaaaagacattattggactaagttagtaggtcagccttttcctttgatagtgtgtactcttatctgtcacccaaccttctccacaccctcttctcttcattcagttgtggacagcagtaattttttcaggacctttgcttcttagaggaaatacatttttccttatttatatttttaaaagatgtttctattacattatatatagcaagagatctattaaggatccagaaaatcttaacctgtagaggatatgagttcctcatcataagaattagtttccttgagggttctttagtatattctatttacacagtttatgcataagtaaactctgtggccgatgtacataaaaaaacctatcacttttatgctcattcatcctcctaattcagtgtctgggtcatgagatgtttggttcatagcttcaaaaactgttcaagaagactgatttcagttctctctatgttgatcttccagttgaatctggagtcttctgattgtggaaaggagtagcagatcacattatactgaaaattgtccttttcattgagaaataaaggttgactgagctacctaaagtcactttcctttggactgtaagccttagagagaacaataatacctttgcttttcttgaggtagtattagaaaactctagttcccattgataggataaacttgttttctcgtttcatggtctttttatagaaaacagtcacaaaatcttgacatttggcatccctgaaaagctcaagtggccttttcaagtagggtatcatgtagtattctgcaggtttacagtcagtatcctgcaaggaaaggtgacaaacttcctgtgaagttaggaagaaatattagtaacccacacacttgaagtgagttttccattttaccttgtagaaattgtactagagatagaacaaatgaaattagttttcttttccaggtatatcctgtgagataccagcacagagtattttctctgagttctctcagggttaaagctcagtgagcttttcttttctctttggtagtgtggaaccatttgtaccgtagaaagaatagctggaaatatggaactccaatgtggcaatacagtaataaacagaaggaatgagtcagtaggataatatattcgagtgatttctgtatatttcagttataatgttttttatatagtgtatatttcagttatttcagttataatgtgttttagaatgtggatttaagccaccttctcaccctttgcaccagtagctttgttaaaacattttattatgatcaaataacaagcctgttgcttttaagtaatctaagtattaacagaaggtaagtcttcaacttctccctgttctcacctgggccaagatcaattttctaaataaaaaatagctttgtaatttgtctccaacaaagaatgggaaatggaagggaacacaaaactgtggtcctgacaatactaattctacccgttttcaaataagaataattaaacttataaagtgatatactgattatttttgtgttactctcccttttttttgtttaaagtcaaattccagaagtaaaaatctttatcatactgttttcctcttactaaaactggaagggtaaaatagaaagttcagcaacatcagaaaatgttgtatttaaaataatatggagaataggggttttaagtacataaaccatattggcttccttgtaggtttacttttagtatataacatgaatatgtagtgcttctttttacaataatcaaagtcatagctccaagatattgacctctttctcaatctataacctttgtaggcatgcatttataccagcatgttttataaattatgagtttctatctgtgtccatgaagtcttactagttttcacttaaacttttgtgggttgttaagaagaattaaagtgattcataacttcacgcttgaacctgggaggtggaggttgcagtgagccgagatcatgccattgcactccagcctgggcaacaagagtgaaactctgtcttaaataaataaataaagtggttcataacatcagatgaagaaggaggtgagtgatatgttaaatgatcagaaacttggcattacattatttccaggaccatttccctaccaaagctgtgtatttttcatttcttcatggcactgtgctgttaatttctgttaacatttgtgctaaaatggagtgtaatttttacatataagtgttagaattttagctatcttagttgaaacacaaaaagttgttactgatccaataaaattatcaaaggccaacaaaaactattt

SEQ ID NO: 430566 - DNA, 2197 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactg

SEQ ID NO: 430567 - DNA, 1760 bp, Homo sapiens
  misc_feature (1670)..(1670): n is a, c, g, or t
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggttagacaaacttatcactggggtaaaactacgatttgtaaggatgactgcttgtgttctgttggttgttaaggtaatcnttgtaggctaaaagtttagcattttctcaacatttgggacattgtatcaattgataacactataaagaagaataaataatccttcctgtt

SEQ ID NO: 430568 - DNA, 3240 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaa

SEQ ID NO: 430569 - DNA, 3184 bp, Homo sapiens
tatacctctacatacaatatgaagtgcttaccacaatcaagctaattaacatagttgcctccgtgtgtgtgtgtgtgtgtgtgtgtgtgtgagtgtggtgagaatacttacaatatattctcttagcagatttcaagtctacaatacattattattaactgtagtcaccatgctgcacattaggtcttcagaactttctcagtttaagctgaaatttgtacccaatcgttttgttaaaaacatgtaacatctgttttctgtgcttgctgcttacacgttcttgttttccccaacaaatgttgccaacaaaatgagacacagctgctggtgacatttgtagaggaaaacggatgatgcctcatttttgtaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaa

SEQ ID NO: 430570 - DNA, 4362 bp, Homo sapiens
  misc_feature (3638)..(3638): n is a, c, g, or t
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaaaaaaaaaaaaaaaaaaaaaaaaaaaaaaaaaaaaaaaaaaaaaaaaaaaaaaaaaaaaaaaaaaaaaaaaaaggggggggggctttttttccccggggggggccatacccccccttttttttaagggggcccaaggagggaggttatattatattgaacgcaggagggagcggggcgcttttaaaaaaagcgctgtggtgatggggaagaaacacgaatgcagtggggaacatttttggaggaggagaaaccacactattcggtgagggatgggtgacacacaatggtggagcaaacacctactcccgagagaagtatatgaagacgcatgcggagagagnaaatataaaacaattatgaggtgtgtattgaagtcgggtgtcaacacaccagggtcaatatatgtatgggggtacagaaaaatgtggcacactgggggaagagatgttcgtgagaaaaattatctttttgagcgcgcggcggcttcctcttgctcataccatacacgtgagagaagaagaaacgaaagacaagaaagagcagaaaaagacaagtcagagaacagttaaggaaaacgagagaaagaggaagagaagagagtaatagaaaagaagacgaaaagaaacgaaaagcagagagaaaagaaaagaaagagaagaaagaagagaaacaataaaaaagagaaagaagagcgaaaaaagaagaaaaaaagaaaagaaacagacgagaagaggcgaaaaggaaaagaagcaagaaagaaaaagaaacacaagaagagagcgaacgaagtacgaaacagacagaaccacaagagaaagaacaacaagagacgagaagaaaaaagaagaagaagagagaaaacaaaaaagaagagaaagaaagaaagaaagaagagagacaaaagagaagatagaaagaaatagaagcagacaaaaacagaaagaagaacagaagaagaaagacataaagaaaaccgagaaggaaacaaacggtaacagataagaatgaaaaaacagagagaacgaacaagaaggaacagacaaacgagaacagaaaaacaataac

SEQ ID NO: 430571 - DNA, 4169 bp, Homo sapiens
  misc_feature (3445)..(3445): n is a, c, g, or t
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattaaaaaaaaaaaaaaaaaaaaaaaaaaaaaaaaaaaaaaaaaaaaaaaaaaaaaaaaaaaaaaaaaaaaaaaaaggggggggggctttttttccccggggggggccatacccccccttttttttaagggggcccaaggagggaggttatattatattgaacgcaggagggagcggggcgcttttaaaaaaagcgctgtggtgatggggaagaaacacgaatgcagtggggaacatttttggaggaggagaaaccacactattcggtgagggatgggtgacacacaatggtggagcaaacacctactcccgagagaagtatatgaagacgcatgcggagagagnaaatataaaacaattatgaggtgtgtattgaagtcgggtgtcaacacaccagggtcaatatatgtatgggggtacagaaaaatgtggcacactgggggaagagatgttcgtgagaaaaattatctttttgagcgcgcggcggcttcctcttgctcataccatacacgtgagagaagaagaaacgaaagacaagaaagagcagaaaaagacaagtcagagaacagttaaggaaaacgagagaaagaggaagagaagagagtaatagaaaagaagacgaaaagaaacgaaaagcagagagaaaagaaaagaaagagaagaaagaagagaaacaataaaaaagagaaagaagagcgaaaaaagaagaaaaaaagaaaagaaacagacgagaagaggcgaaaaggaaaagaagcaagaaagaaaaagaaacacaagaagagagcgaacgaagtacgaaacagacagaaccacaagagaaagaacaacaagagacgagaagaaaaaagaagaagaagagagaaaacaaaaaagaagagaaagaaagaaagaaagaagagagacaaaagagaagatagaaagaaatagaagcagacaaaaacagaaagaagaacagaagaagaaagacataaagaaaaccgagaaggaaacaaacggtaacagataagaatgaaaaaacagagagaacgaacaagaaggaacagacaaacgagaacagaaaaacaataac

SEQ ID NO: 430572 - DNA, 1936 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcggtaaaagcttaagcttttaccgcatttatattaaaaattcacacacaaatgaaaatggaaaaactgccaatacctgatttctgtcccctatttttccactcgcaatcatatacttaggtaccttttgaccccatggaaaaaaaatatctaacgttcagaactaccaataacaggaagaagagaaattttattatttttggagaatgaattgtttcccatcatagtgaattcttaagcacgtactccacgtatgcggagtgctagctggatgtctttgggcataattgttccacgttgggcatgggcggtaaaagctggggtaccgagct

SEQ ID NO: 430573 - DNA, 1393 bp, Homo sapiens
  misc_feature (1326)..(1326): n is a, c, g, or t
  misc_feature (1342)..(1342): n is a, c, g, or t
  misc_feature (1361)..(1361): n is a, c, g, or t
  misc_feature (1376)..(1376): n is a, c, g, or t
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatggtgcctgggcttangtaaccactttacccnggatatgggaggcacttgntacccccctggatgnaacaatgggtggatttt

SEQ ID NO: 430574 - DNA, 700 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgtaggtatccaggattctgaattcccaactaaacaacaaaatgtcttgtcatcaatcccggaaataaaatgaatgatgtatagctggtgttaatgcatatagtgggagc

SEQ ID NO: 430575 - DNA, 185 bp, Homo sapiens
tgctgggattataggcgtgagccaccacccccggcccggccttgacattttctgttgagtcacattaagtggttttacccctaggggatgatggaactaacaaagaagccacaagcacaggaaagttgaaccaggagaatgagcacatctataacctgtggtgttctggtcgagtgtgctgtgag

SEQ ID NO: 430576 - DNA, 762 bp, Homo sapiens
cacattgtagcattcatcatgccttttaaatatgagatggagggcaattgatagtcaaaggattcatataggcagagattacaaaggaatcttcaatgacagaactaaattatatatgctgtagtagattatccctaaatttactctgagcctaactcaaaaataagataataagatgccttgttataggaagatagaataggagttggaaataaaacataaaaatgcatcaaaataagcaaaaatgtatctaaaatatgggcctcatacttaaatataggctcatttctggctccccaggtgagatggaatatacccttgcctggagggaacatcactggaggtgttcaaatataggataaagatcacttgagaatgcatccatcagatagacgagtggaccagatgacctgtaaagctccttcattatatttgacttgggtatgccaagccaaatactgtgctgattatgtgcaggtatctgttcatctaagtgtattgggtgacttgtgtacatggaaaacatctttcttgtattccttcttaattgccttttcttttatgacagggaaggtcagcctttaaagctacctgacactaagaggacactgttgtttacatttaatggtaagtattctgggtcctttctgggttcttagtcttctctgagatgaccttaaggagagtattgtttcctcctaaatgatagctttaaaactacgtcaaaactataagcctgtgcttgcttactgatttccagat

SEQ ID NO: 430577 - DNA, 3297 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaa

SEQ ID NO: 430578 - DNA, 2145 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatg

SEQ ID NO: 430579 - DNA, 3243 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttattacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaa

SEQ ID NO: 430580 - DNA, 3016 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaactgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaa

SEQ ID NO: 430581 - DNA, 2487 bp, Homo sapiens
  misc_feature (132)..(132): n is a, c, g, or t
ccggaagatggacctctcagcttaccaccatatcctagcctccctatagctcccattcctattaatgataatcttcctctaatctcccctgcctcaaggaaatctgccaacaatattgaaagtaggccagtnagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaa

SEQ ID NO: 430582 - DNA, 3069 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggatggtaccggtgggtccggggagtgggggggggatcgtggagcttagtgccggcgtcggggcataccagtgctctgaaccgcctgtgtgtgcctgtatgcgcgggaccttcccctggttccccctctcccatttccgggagccgtcgttcttccgccgcggcttcaccacccccctcttttttgggggcgcccccttacacggttttcttgagccccccggggttcccctctgaa

SEQ ID NO: 430583 - DNA, 1115 bp, Homo sapiens
cgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtaagtcttgtctcttgaggaacctcagctggataagcatgccctcacagaacactcg

SEQ ID NO: 430584 - DNA, 303 bp, Homo sapiens
agatttttactgtttataaaatctgatcagtatgtatagaatggcaatccattttggggttctctttttttttaagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtgg

SEQ ID NO: 430585 - DNA, 6933 bp, Homo sapiens
tgcggccgccgcccccggctgcgcgctgagccgccggccccccgagcgccacggccggagctgcggcggcggcatcatggccccgaccctgctccagaagctcttcaacaaaaggggcagcagcggcagctccgcggcggcgtctgcccagggcagggctcctaaggaaggacccgcctttagttggtcatgttcggagtttgacctgaatgagattcgcctgatagtttaccaggactgtgacaggagaggcagacaagtcttgtttgactctaaagctgttcaaaagattgaggaggtgacagctcagaaaacagaggatgttcctattaaaatatcagccaagtgctgccagggaagcagcagtgtcagcagcagtagcagcagcagcatctcttcccacagttcttctgggggatcttcacatcatgctaaggaacagcttccaaagtaccagtacacaagaccagcttccgatgtcaacatgttaggggaaatgatgtttggctcagttgccatgagttacaaaggctccaccttaaagatacactacatacgttctcctccacaactgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatggaagctctgggagaattcagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggggatgagaaaaataaagaggcaccgcaagatggctcttcaagacttcccagctgtgaagttttgggggcaggaatgaagatggaccagcaagctgtctgtgagctgttgaaagtggagatgcctacaagactgccagaccggtcagtggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtctcagagcatcagcacccagaatgtaaggaactttggccgctcacttctggcgggctactgccccacatacatgcctgatcttgtgcttcatgggaccggcagtgatgagaagctgaagcagtgcctggtggccgaccttgtccacacagtccatcatccagtcctggatgagccaatagctgaagctgtctgtattatcgcagacacggataaatggagtgtgcaggtagctacaagtcagaggaaagtgacggacaacatgaaactaggccaggatgtcctggtctctagtcaggtgtccagtttgcttcagtccattttacagctctataagcttcacctccctgctgatttttgcatcatgcatcttgaagatagactacaggagatgtaccttaaaagtaaaatgctatctgaatatctccggggacacacacgagtccatgtgaaagaattaggtgtcgtactggggattgaatccaacgacctgcctctgttgactgctattgccagtactcattctccttatgtggctcaaatactcttataagctaaagctcaggacagttcttccttggaagaaaaaaatcaaattctcaactgaaggagaaaggaataagctctctgtgatgtcaaaagcatgagaagagcaaacagaaacagtcattccacctttttgttttgtgtttttgctgtcaagctgatgcttcattgaagacttaggtttacttgacataatagcatttgtgattgtcgtgaacactttaggccatttgttacccatgaatcaacaaagaaactgacctttttggtaggaggaaacataagcactaaacactaagctgttgcaacagattgccttgtgctgtttgggcagaataaagacaagtgacttgagcggggtggtcagcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaagaaagccacattgtgccatcttcagctccagtggctttagcagtgactgtttgacataaaacatgtaagaattgcttgttgggaagagtgctttagggacccactgttttcatttcttcttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagaggccacttaccaaagttatttctataagctcaagagtgtttcggttggtaagttcttccagctgaagccactttttccttatagttaatacaaatgactatttttactttaaaaggcacagctgtcctggtgggaaatgaaacctgcagcagttcaggatgactaatgaaagcaattagcttgaacatttagaaaaaattcatatatgatctaaatttttatattatcatttctgtgccttctaattcctgcatcctgttcaaaacatctttccagacattaacttacacattgtataaaaccgaccaaaatgatttcctaaagttcatgcaaaaaaaaaaaaaaacaacctaattttctgttaatataaaagaaacttcagtttactgaccgtgaaacagactatgtactgacatccagggtaaagtaaaagacttttaaatattggtcattaaaggacaggagctaagctagcaaagcaaaacatctttagcactttgcagatctcaagcagttaaccaggctctgattcccttccactgttttatgaattaattccagttcttttcatgtatctttgaacctaagattatgaagtaatttccctattagggactagaatgacttcagttttttcatttgataaaaatcagaactgctacctttcccttttttaatgatgcaaaatgtagatgagtgcattaaggtttgtaagatctttatcattttatgtcattcattgaaaattgaaatgttcattctttttaatgttttcctatttccttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttctttgtcttaaattcagcctcttcctaaaagcaaaaaagaaaaaaaaaacctcacagaattgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattccacctttagggtttcttcaacttttaagtcttacctgttgagtgtaacttttgtagcatcttgcttttccaagcaagctagtgaggcatgacagagcagaagtctgtaaatgtccctgtgatggacctctttctagcatgttgcagttttatttttaataaattggtaagtgaaatgaatgtaaaggtaattgtgtacgttttagacatgacaatgaaaatttaaaatgtagcttccatacttgtgcataattccaaagtattttattttttatcaatcagtgttaaatagctttttgtacaggcttcaatccatttttcgaagtgtgctgttttttaatgaaagtaactataatcttttcacatcccatggaactgccgtttacacattgcaactttttaaacttaaccatatttttcaaaattaacgtttttggagggagaaaaatccccgcttgctaaatgatactaaaccgttgtttgggctcttataattaggtcctgagattttataaaaatttagtctgtagctttttaggttcttcactagagttggttgtacataaaaataataaagaatataaagtatcccaaaattcttttaaagtctggatttttccgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaacttaagtggtatttcaaaaacgagaaaattctggaatttgtcatttgaagctccataagagaaattgataggacttcgtttttgatcagtctgaatagataccaatgtcattgtgtgggaattttttttaacttgtttatgtattattttgatccatttttctgtggcatttggtgcaataaaacttttgaatttatcttgaacattttc

SEQ ID NO: 430586 - DNA, 7078 bp, Homo sapiens
gcttttctcacatactgtatagggagtgaaatgatgtttagaactgctggtcattacagaatgttcctcacataacaaaggaacttcaggattgtctccaagtccatgtttatggtcaggataaaccagaagaacattaaaccgttcaggagatgtgcggcggcacagcgaacaccacaaaccagccagagagctggcaagactctgccagatgtgtgagtgatgctgttcctggtgctgggaggatttacagggcgcttttatgcacaaagattaaaaaacacaccggagtagacaggagcactgaccacacggaactcgacaacagttggtcatgttcggagtttgacctgaatgagattcgcctgatagtttaccaggactgtgacaggagaggcagacaagtcttgtttgactctaaagctgttcaaaagattgaggaggtgacagctcagaaaacagaggatgttcctattaaaatatcagccaagtgctgccagggaagcagcagtgtcagcagcagtagcagcagcagcatctcttcccacagttcttctgggggatcttcacatcatgctaaggaacagcttccaaagtaccagtacacaagaccagcttccgatgtcaacatgttaggggaaatgatgtttggctcagttgccatgagttacaaaggctccaccttaaagatacactacatacgttctcctccacaactgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatggaagctctgggagaattcagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggggatgagaaaaataaagaggcaccgcaagatggctcttcaagacttcccagctgtgaagttttgggggcaggaatgaagatggaccagcaagctgtctgtgagctgttgaaagtggagatgcctacaagactgccagaccggtcagtggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtctcagagcatcagcacccagaatgtaaggaactttggccgctcacttctggcgggctactgccccacatacatgcctgatcttgtgcttcatgggaccggcagtgatgagaagctgaagcagtgcctggtggccgaccttgtccacacagtccatcatccagtcctggatgagccaatagctgaagctgtctgtattatcgcagacacggataaatggagtgtgcaggtagctacaagtcagaggaaagtgacggacaacatgaaactaggccaggatgtcctggtctctagtcaggtgtccagtttgcttcagtccattttacagctctataagcttcacctccctgctgatttttgcatcatgcatcttgaagatagactacaggagatgtaccttaaaagtaaaatgctatctgaatatctccggggacacacacgagtccatgtgaaagaattaggtgtcgtactggggattgaatccaacgacctgcctctgttgactgctattgccagtactcattctccttatgtggctcaaatactcttataagctaaagctcaggacagttcttccttggaagaaaaaaatcaaattctcaactgaaggagaaaggaataagctctctgtgatgtcaaaagcatgagaagagcaaacagaaacagtcattccacctttttgttttgtgtttttgctgtcaagctgatgcttcattgaagacttaggtttacttgacataatagcatttgtgattgtcgtgaacactttaggccatttgttacccatgaatcaacaaagaaactgacctttttggtaggaggaaacataagcactaaacactaagctgttgcaacagattgccttgtgctgtttgggcagaataaagacaagtgacttgagcggggtggtcagcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaagaaagccacattgtgccatcttcagctccagtggctttagcagtgactgtttgacataaaacatgtaagaattgcttgttgggaagagtgctttagggacccactgttttcatttcttcttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagaggccacttaccaaagttatttctataagctcaagagtgtttcggttggtaagttcttccagctgaagccactttttccttatagttaatacaaatgactatttttactttaaaaggcacagctgtcctggtgggaaatgaaacctgcagcagttcaggatgactaatgaaagcaattagcttgaacatttagaaaaaattcatatatgatctaaatttttatattatcatttctgtgccttctaattcctgcatcctgttcaaaacatctttccagacattaacttacacattgtataaaaccgaccaaaatgatttcctaaagttcatgcaaaaaaaaaaaaaaacaacctaattttctgttaatataaaagaaacttcagtttactgaccgtgaaacagactatgtactgacatccagggtaaagtaaaagacttttaaatattggtcattaaaggacaggagctaagctagcaaagcaaaacatctttagcactttgcagatctcaagcagttaaccaggctctgattcccttccactgttttatgaattaattccagttcttttcatgtatctttgaacctaagattatgaagtaatttccctattagggactagaatgacttcagttttttcatttgataaaaatcagaactgctacctttcccttttttaatgatgcaaaatgtagatgagtgcattaaggtttgtaagatctttatcattttatgtcattcattgaaaattgaaatgttcattctttttaatgttttcctatttccttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttctttgtcttaaattcagcctcttcctaaaagcaaaaaagaaaaaaaaaacctcacagaattgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattccacctttagggtttcttcaacttttaagtcttacctgttgagtgtaacttttgtagcatcttgcttttccaagcaagctagtgaggcatgacagagcagaagtctgtaaatgtccctgtgatggacctctttctagcatgttgcagttttatttttaataaattggtaagtgaaatgaatgtaaaggtaattgtgtacgttttagacatgacaatgaaaatttaaaatgtagcttccatacttgtgcataattccaaagtattttattttttatcaatcagtgttaaatagctttttgtacaggcttcaatccatttttcgaagtgtgctgttttttaatgaaagtaactataatcttttcacatcccatggaactgccgtttacacattgcaactttttaaacttaaccatatttttcaaaattaacgtttttggagggagaaaaatccccgcttgctaaatgatactaaaccgttgtttgggctcttataattaggtcctgagattttataaaaatttagtctgtagctttttaggttcttcactagagttggttgtacataaaaataataaagaatataaagtatcccaaaattcttttaaagtctggatttttccgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaacttaagtggtatttcaaaaacgagaaaattctggaatttgtcatttgaagctccataagagaaattgataggacttcgtttttgatcagtctgaatagataccaatgtcattgtgtgggaattttttttaacttgtttatgtattattttgatccatttttctgtggcatttggtgcaataaaacttttgaatttatcttgaacattttc

SEQ ID NO: 430587 - DNA, 245 bp, Homo sapiens
gttttgctttttcattagttttaaatgataatctatcaaacttagtacctagaaataatactttctcataaaaagaaataatactttctcataaaaccatgctcttttaaagtaatattcttttcttttctcaatattcaggattgaatccaacgacctgcctctgttgactgctattgccagtactcattctccttatgtggctcaaatactcttataagctaaagctcaggacagttcttcct

SEQ ID NO: 430588 - DNA, 755 bp, Homo sapiens
tacatttttagctgtgcattttaatgggccacatgttgttttaggtctcagagcatcagcacccagaatgtaaggaactttggccgctcacttctggcgggctactgccccacatacatgcctgatcttgtgcttcatgggaccggcagtgatgagaagctgaagcagtgcctggtggccgaccttgtccacacagtccatgtaagtgatcccagtgtggagcctctggctgctgacagtgtgtcagtcaaggtcttggctgacaacaggtgtttagactgaagagagactagttaaggggttgtttatggagatgtgggcagggttatgggaaccagctagggctagtgaggcacctggggcctagcagcagctggaagctagaaagcacacctgggcctgacagagtaaggggagggtgcgtgacatcagagccctggagaacctaagccaggacgaggggcggcctggctgcaggagcagtgaggagggggtgacttcctgccatccctcctcccattctctggtctctttctggtgcctctcattggctgagcccggctgaaagccagagagcaggggcacagctgatgcagacacacagccttgtggtgcatagaggtcagcctcctggggcccagaacagaacacagaagggcaaggagctgctctgggggtggtgggttagcagataggctgggcaaatggaataaacagcacagatggtgacaattatatgccgtcacggtgaggac

SEQ ID NO: 430589 - DNA, 7023 bp, Homo sapiens
tgcggccgccgcccccggctgcgcgctgagccgccggccccccgagcgccacggccggagctgcggcggcggcatcatggccccgaccctgctccagaagctcttcaacaaaaggggcagcagcggcagctccgcggcggcgtctgcccagggcagggctcctaaggaaggacccgcctttagttggtcatgttcggagtttgacctgaatgagattcgcctgatagtttaccaggactgtgacaggagaggcagacaagtcttgtttgactctaaagctgttcaaaagattgaggaggtgacagctcagaaaacagaggatgttcctattaaaatatcagccaagtgctgccagggaagcagcagtgtcagcagcagtagcagcagcagcatctcttcccacagttcttctgggggatcttcacatcatgctaaggaacagcttccaaagtaccagtacacaagaccagcttccgatgtcaacatgttaggggaaatgatgtttggctcagttgccatgagttacaaaggctccaccttaaagatacactacatacgttctcctccacaactgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctaggtctgctgcaagcatgcagcagcaaactgctgcagggggtagctgaaggaggacctctccggctcacccggagtgcttctttctttgcagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatggaagctctgggagaattcagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggggatgagaaaaataaagaggcaccgcaagatggctcttcaagacttcccagctgtgaagttttgggggcaggaatgaagatggaccagcaagctgtctgtgagctgttgaaagtggagatgcctacaagactgccagaccggtcagtggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtctcagagcatcagcacccagaatgtaaggaactttggccgctcacttctggcgggctactgccccacatacatgcctgatcttgtgcttcatgggaccggcagtgatgagaagctgaagcagtgcctggtggccgaccttgtccacacagtccatcatccagtcctggatgagccaatagctgaagctgtctgtattatcgcagacacggataaatggagtgtgcaggtagctacaagtcagaggaaagtgacggacaacatgaaactaggccaggatgtcctggtctctagtcaggtgtccagtttgcttcagtccattttacagctctataagcttcacctccctgctgatttttgcatcatgcatcttgaagatagactacaggagatgtaccttaaaagtaaaatgctatctgaatatctccggggacacacacgagtccatgtgaaagaattaggtgtcgtactggggattgaatccaacgacctgcctctgttgactgctattgccagtactcattctccttatgtggctcaaatactcttataagctaaagctcaggacagttcttccttggaagaaaaaaatcaaattctcaactgaaggagaaaggaataagctctctgtgatgtcaaaagcatgagaagagcaaacagaaacagtcattccacctttttgttttgtgtttttgctgtcaagctgatgcttcattgaagacttaggtttacttgacataatagcatttgtgattgtcgtgaacactttaggccatttgttacccatgaatcaacaaagaaactgacctttttggtaggaggaaacataagcactaaacactaagctgttgcaacagattgccttgtgctgtttgggcagaataaagacaagtgacttgagcggggtggtcagcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaagaaagccacattgtgccatcttcagctccagtggctttagcagtgactgtttgacataaaacatgtaagaattgcttgttgggaagagtgctttagggacccactgttttcatttcttcttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagaggccacttaccaaagttatttctataagctcaagagtgtttcggttggtaagttcttccagctgaagccactttttccttatagttaatacaaatgactatttttactttaaaaggcacagctgtcctggtgggaaatgaaacctgcagcagttcaggatgactaatgaaagcaattagcttgaacatttagaaaaaattcatatatgatctaaatttttatattatcatttctgtgccttctaattcctgcatcctgttcaaaacatctttccagacattaacttacacattgtataaaaccgaccaaaatgatttcctaaagttcatgcaaaaaaaaaaaaaaacaacctaattttctgttaatataaaagaaacttcagtttactgaccgtgaaacagactatgtactgacatccagggtaaagtaaaagacttttaaatattggtcattaaaggacaggagctaagctagcaaagcaaaacatctttagcactttgcagatctcaagcagttaaccaggctctgattcccttccactgttttatgaattaattccagttcttttcatgtatctttgaacctaagattatgaagtaatttccctattagggactagaatgacttcagttttttcatttgataaaaatcagaactgctacctttcccttttttaatgatgcaaaatgtagatgagtgcattaaggtttgtaagatctttatcattttatgtcattcattgaaaattgaaatgttcattctttttaatgttttcctatttccttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttctttgtcttaaattcagcctcttcctaaaagcaaaaaagaaaaaaaaaacctcacagaattgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattccacctttagggtttcttcaacttttaagtcttacctgttgagtgtaacttttgtagcatcttgcttttccaagcaagctagtgaggcatgacagagcagaagtctgtaaatgtccctgtgatggacctctttctagcatgttgcagttttatttttaataaattggtaagtgaaatgaatgtaaaggtaattgtgtacgttttagacatgacaatgaaaatttaaaatgtagcttccatacttgtgcataattccaaagtattttattttttatcaatcagtgttaaatagctttttgtacaggcttcaatccatttttcgaagtgtgctgttttttaatgaaagtaactataatcttttcacatcccatggaactgccgtttacacattgcaactttttaaacttaaccatatttttcaaaattaacgtttttggagggagaaaaatccccgcttgctaaatgatactaaaccgttgtttgggctcttataattaggtcctgagattttataaaaatttagtctgtagctttttaggttcttcactagagttggttgtacataaaaataataaagaatataaagtatcccaaaattcttttaaagtctggatttttccgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaacttaagtggtatttcaaaaacgagaaaattctggaatttgtcatttgaagctccataagagaaattgataggacttcgtttttgatcagtctgaatagataccaatgtcattgtgtgggaattttttttaacttgtttatgtattattttgatccatttttctgtggcatttggtgcaataaaacttttgaatttatcttgaacattttc

SEQ ID NO: 430590 - DNA, 3939 bp, Homo sapiens
tgcggccgccgcccccggctgcgcgctgagccgccggccccccgagcgccacggccggagctgcggcggcggcatcatggccccgaccctgctccagaagctcttcaacaaaaggggcagcagcggcagctccgcggcggcgtctgcccagggcagggctcctaaggaaggacccgcctttagttggtcatgttcggagtttgacctgaatgagattcgcctgatagtttaccaggactgtgacaggagaggcagacaagtcttgtttgactctaaagctgttcaaaagattgaggaggtgacagctcagaaaacagaggatgttcctattaaaatatcagccaagtgctgccagggaagcagcagtgtcagcagcagtagcagcagcagcatctcttcccacagttcttctgggggatcttcacatcatgctaaggaacagcttccaaagtaccagtacacaagaccagcttccgatgtcaacatgttaggggaaatgatgtttggctcagttgccatgagttacaaaggctccaccttaaagatacactacatacgttctcctccacaactgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatggaagctctgggagaattcagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggggatgagaaaaataaagaggcaccgcaagatggctcttcaagacttcccagctgtgaagttttgggggcaggaatgaagatggaccagcaagctgtctgtgagctgttgaaagtggagatgcctacaagactgccagaccggtcagtggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtctcagagcatcagcacccagaatgtaaggaactttggccgctcacttctggcgggctactgccccacatacatgcctgatcttgtgcttcatgggaccggcagtgatgagaagctgaagcagtgcctggtggccgaccttgtccacacagtccattaaaactgctgtcaggaatgtctactcaacatgggatctaattaaagagcttctgcatggcaaaagaaactaccatcagagtgaacaggcaacctacagaatgggagaaaatttttgcaatctacccatctgacaaagggctaatatccaaatctacaaagaacttaaacagatttacaagaaaaaagctaacaaccccatcaaaaagtgggcaaaggatatgaacagacacttcacaaaagaagacatttatgcagccaacagacacatgaaaaaatgctcaccatcactggccatcagagaaatgcaaatcaaaactacagtgagataccatctcacaccagttagaatggcaataattaaaaagtcaggaaacaacaggtgctggagaggatgtggagaaataggaacacttttacactgttggtgggactgtaaactagttcaaccattgtggaagacagtgtggcgattcctcaaggatctagaactagaaataccatttgacccagccatcgcattactgggcatatacccaaaggattataaatcatgctgctataaagacacatgcacacgtatgtttattgtggcactattcacaatagcaaagacttggaaccaacccaaatgcccatcaataatagactggattaagaaaatgtggcacatatacactacggaatacaatgcagccataaaaaatgatgagttcatgtcctttgtagggacatggatgaagctggaaaccatcattctcagcaaactatcgcaaggacagaaaaccaaacaccgcatgctcactcataggtgggaattgaacaatgagaacacatggacacaggagggggagcatcacacactggaggtggcagtgcctgtttatgaactaaataaataaatattaaacacct

SEQ ID NO: 430591 - DNA, 3844 bp, Homo sapiens
gagatagtggtcttggagaggcgttggtttaaaatgcacttatgtaagtttgagctgttttcttttcttcagcttaattgggaactagaagatacgtggttgcaaaaaaagcagaaccagacacaccatgggcatcattctgtcccaggacaatgggaagggtcccaggggcaggtgtgccaaggtggccctgcccacccatccagcgtacccgtaaacacataccaggtgccatgggccctgctgggtaccacatggagagcttctcagtctaaaccaccataaaagtcaaggctgatgtttgtggcacagagtgggtaggtccatccagggacgtcatggggaaaccactgccatgcagctcagcacccacaagtgccggtctcaggccagccctagatgacactgttcaatttgtcaagtccacagatagggttggggtttttgttgtttttcttttctgatcttacctagtagtgcaataccacatttaaagtttaattctcttcccagaatgtcttgtggaaactttacatttcattcctgttcacattgtaagatctctgatgtttgcctggatggatttactgtgattgcacagggaccacgtggctcaggtgtctgagccattgagggcatcttgcaagggctggttttccttttctcatcagtgttggctggatgccagcaggggttttgtggctaaccacatcaggcagtttcccatttttgtagctttgttatacctaaaccgcagtctcatcattttgcttatgcagctagaagtttcagtctgtatagttgttattcattctgtccctggtaattttagacctgccttcttgatgctttaggggccattggggcacagctttctacattggctaacaaatacctgtgaaaatgttaacagacagaagcgcagcagtgaacctgaggtcaggacaggactgtttgggaggttcttcttttcttactgtcactccaaaaataaaccttggatttgtgtgctggggagaaatgagtatagataacatttaaaacgttttcctaaaccttagtattcatatggtagctgatggttcctctccccttcattactgttgcctgacgacggtccttgctgatgctgtgaactaacaaagttgtctttttgtttttaagggaacccaccctggcgtctggacagcaggttaggtttgggtggttttgagctagcactgctgtggggcaggggtggccgctccctggtgaagctaatgctgtggaagctggaatgttccttcctaaggagtgggatcatgcccctaccccagcagaggtatctcatcactcgctcatgtgcgagattctaaataaattttgttcttgggcatcttctactaggcctcctataaaatagatcttgctgtttttggtttgtgttaatggaacctcactttctagagataattctttagttttttatttaggaagttttcaaaatatacaaagcaggaatgtaaggaacccgcatcacctcaaattcagtgttacccacacttgaccatgcttgccccagctgtgccttttttctttccttgggtattttgttgctaaagtattttattattactgttttagagacagggcctcactcctgtcacccaggctggagtatggtggcacagtcacatctcactgcagcctcaacctcctgggctcaagccatccccccaccccagcctcctgagtagctgggactacaggcacacatcactgcgcccagctaatttttaaaaaatttttgtggagacaggttctcttcatgttgcccaggatggtcttgaattcctgggctcaagcagtcctcctgtctcagcctcccaaagtgccagaattgcaggcatgagcctgggtgctagagcgaggccctgtctcaaaaaaaaaaaaaaaaaaaatcaatcaaggctttcttccgagttactgctcacagccctcttacccctttctcttgtgagtgggttgtaatgtccacccagaggggatttagacacggaagggaaggcaagcgtgggcaccatggctttagaaccataaggaagacatttccctctacagattctgtctttccacttgtaacagttaatgaggcactgacgttgctcttttccaccttaacaagacagtttacagtggttaaatagcaaaactccaggagcaattcagcctgaggccatagtgccctgcagcagcattgggctctgcttttgtttctgctttgtgctttgtggctcttcttcaagccagtgttgggtagtgcacagcctgagaggtgtggcctgataaaccctgaaattgaaagaagtatgcagatttgactcagcactcctggaagtgtctggatacagctcactgagagtgtggaggtgaaagtgcctgcaaaatattaacagttctctctcaatctattgatctcctcagttacatccagaaccttaaagccgcacagttgtcatcctccgcccgcagtctcaggcagggcgcatcaggggctgcactggtagctcccaggaggacttacccatgggtcaccgtcatagccaggtgtgtctactcagaggggacgcaatcctgcagcagtccccgtcaatgagaggccaccagcagacagtgcctgttggacccatgaagtccaccactaattatatactctgctttaggtagaatatttttattagctgtcaaactgtttttgtatttaagtttccaaaagtccaggtactttatgtaggccaatgtataaatatttcaagtctaacagtagcacagttatatgttaatacaactgactacacgaaaaatatgtaatagcatatgctatgtaatttttcaaatcactaggtattgatatgtgccttttttatattaccaagagattctctaaatatggaattagattaggattctctgctccacttaacacacatttttaaattagtactgatgattgagggatggacaatagcacaccaaaaaaaaaagagtttagtatgaaaaatttaaacctgttggttaagtcattcccattaatgtcattttgctgagggtgacttggtccttttgaattgctttggtgtacgggtatgttctgatttttcatgcaagctcctctgccattccaccgctctgaggagtaattgtagcacttcacatgtgctgtggttgtgatcacatggtgacatacatagcatgtgtgttcccagctgttgtgtgtttatgtgacatttgatgccaatacatatgtcttcaaggtatgcttgttccctcccagctcgtggaatatcaaaaaaattcattgctggaaaaattatttcatagacaaaaatgttaatgttctcttggggacttagagttgaaaatatttgtatagatttggttctcaagtccacagaatcgtatctgctgtggtctccctttggtgctcatctgggagccatgtgtatggaagattctgtcacaggcggctgggatgtgggcagatgctgttagcctccctctccacgtggtggtccatgcctgacgtgtcccctagttcaaggaagcgccatctttagcatgaaaacaattgcgttcccctaggaaatgaagaaaaaatgagctgaaatttccttatacatttgaatttgttcattttttaaagagacatttttgttgtctgctttgtggtacttataaaatttgttttccattgaaattgccatttataaatttgcagatatgtactaatttagatttttttaagtgttcaataaaataaggatatatttactgtgaatttttaaatgggctttttagctttctt

SEQ ID NO: 430592 - DNA, 356 bp, Homo sapiens
ctagttcaaggaagcgccatctttagcatgaaaacaattgcgttcccctaggaaatgaagaaaaaatgagctgaaatttccttatacatttgaatttgttcattttttaaagagacatttttgttgtctgctttgtggtacttataaaatttgttttccattgaaattgccatttataaatttgcagatatgtactaatttagatttttttaagtgttcaataaaataaggatatatttactgtgaatttttaaatgggctttttagctttctttccctctacttttagttttgatttatataagttaaagattcttttgcatattaatccctgaagcagctgcatattttttata

SEQ ID NO: 430593 - DNA, 751 bp, Homo sapiens
gccgacgcaaggctgctgctatggggccgggcggccgtgtggcgcggctgctcgccccactaatgtggcgcagggcggtttcctcggtggcggggtccgcggttggagccgagcccgggcttcggctgctggccgtgcagcggcttcccgtaggagcagcgttctgccgggcttgccagaccccaaactttgtccgcggcctgcacagcgagcctgggctggaggagcgggcggaggggacggtcaacgagggacgcccagaatcggacgcggcagatcatactggtcccaagtttgacatcgatatgatggtttcacttctgaggcaagaaaatgcaagagacatttgtgtgatccaggttcctccagaaatgagatatacagattactttgtgattgttagtggaacttctacccgacacttacatgccatggccttctacgttgtgaaaatgtacaaacacctgaaatgtaaacgtgaccctcatgttaagatagaagggaaggacactgatgactggctgtgcgtggattttggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcat

SEQ ID NO: 430594 - DNA, 1121 bp, Homo sapiens
ctaattatcatttcctttgattttggggtgatgtatatgagatgtcctttgtctcttgtaacagtttttacttaattgccatcttgtttgatattagtatatctgttttaacaaaagaactgagcacatttataggatgacggggtcccattaacatgtcataaaggcagatgagatgaaatcagtggcactgaaacaacctggctttataaacagaaggtagtatctgcagcccctaaaggtgaaggaaagctgggatgaacacaagtgatggatgtaggtgggtaccaaatgctgactgagcttagctttttcagcctcagaggcaccttggtgaatgaatggggtgaccctctcagaagggctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaggacactgatgactggctgtgcgtggattttggtaagttattctggcgtattttacaggtaactgttggtactacgctaatcttgaattgttttcagttgcaaaaggattgagatcaaattgatgaatgtatttccaggtaagatttttgaagtgtgtttaaggtaacaaaagtttttttagttataatccaggtgctcttattcacatgtagaattttcacctaaccaaaccaaagtaccctagatgatgccctcctggaggaagatatatactacatggtgtgtatctactagccacacagatcaggaaggtggtggacaacaggataacatagtagaggcgggagagattccttattggggattagagaacggccgggggaaactcggacctgtagtgaggtcccaatcttctaatttcttcggggcgagacctggccctgcctggacaggggcctcggggtgattttttaattgtgactaggcaccc

SEQ ID NO: 430595 - DNA, 929 bp, Homo sapiens
ctaattatcatttcctttgattttggggtgatgtatatgagatgtcctttgtctcttgtaacagtttttacttaattgccatcttgtttgatattagtatatctgttttaacaaaagaactgagcacatttataggatgacggggtcccattaacatgtcataaaggcagatgagatgaaatcagtggcactgaaacaacctggctttataaacagaaggtagtatctgcagcccctaaaggtgaaggaaagctgggatgaacacaagtgatggatgtaggtgggtaccaaatgctgactgagcttagctttttcagcctcagaggcaccttggtgaatgaatggggtgaccctctcagaagggctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaacacctgtctatcatggggttgacaccgaagaacagttcaggtcagtccttgaaggtccctccatctgtgtttgtctgacgtttcctccagggaccggaatgctacagaagcaatgctgtgttctcagtgtatcacatcaagagacacttggcacccatttgtcctattcctggtgttgttaactttgttcagctcattaagggaggacctgctgggtttctctactgttaagttaccactttttctctttgcaattaatcaaccatatgattggaactgctatgagacaaagggaaca

SEQ ID NO: 430596 - DNA, 271 bp, Homo sapiens
  misc_feature (40)..(42): n is a, c, g, or t
  misc_feature (52)..(52): n is a, c, g, or t
atcccaccgagccgatccaattaaaaaaaaaaaaaaaaannncctggcgggntcgccgcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcat

SEQ ID NO: 430597 - DNA, 2283 bp, Homo sapiens
ctaattatcatttcctttgattttggggtgatgtatatgagatgtcctttgtctcttgtaacagtttttacttaattgccatcttgtttgatattagtatatctgttttaacaaaagaactgagcacatttataggatgacggggtcccattaacatgtcataaaggcagatgagatgaaatcagtggcactgaaacaacctggctttataaacagaaggtagtatctgcagcccctaaaggtgaaggaaagctgggatgaacacaagtgatggatgtaggtgggtaccaaatgctgactgagcttagctttttcagcctcagaggcaccttggtgaatgaatggggtgaccctctcagaagggctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaggacactgatgactggctgtgcgtggattttggtaagttattctggcgtattttacaggtaactgttggtactacgctaatcttgaattgttttcagttgcaaaaggattgagatcaaattgatgaatgtatttccaggtaagatttttgaagtgtgtttaaggtaacaaaagtttttttagttataatccaggtgctcttattcacatgtagaattttcacctaaccaaaccaaagtaccctagatgatgccctcctggaggaagatatatactacatggtgtgtatctactagccacacagatcaggaaggtggtggacaacaggataacatagtagaggcgggagagattccttagtagtggtagaggaaggtttgggggctgtggtgcataaatgagatgaggatgaggttattccaggcacaaaaaaggacaagagcagaagactagaattttgaaaagatctaacaactttgggtattaatgtgtacatagtttcaaagcacctcccaacaagataatatttacaaaggggaaacataactgtatgtcaagaactgaggagtctgagattttattctgcttgtaagctaatacattgtcccgccagttttcatggacactggtaaaagacaagactattagagggttagagacaaagaacagtttattactcacagcagtagccagcatccattttgcactggtttcctgagctctggattccatagggcaacatgggccagatgacaccagcacacacagttgtaaaactggaactcagatgagggtgtctaggttttttataactggcaggaagcaggcctacttttgctctgatggtttctcacttttgtcgctattaacgttttggaccaggtaattttgcatgtgggggaggggtgtctcttgtgcacggtacgatgtttagcagtatcctcccttctccaattgtgacaatcaaaaatgactctaaacattaccattattacctaattgagaaatgctgctgtaagcaaagctgccctttgccctggagggaggcagtatctttctgttaagaatattcacgatacaaacattcttggatagtcaaaacaaaaggcagtcagtgtttttgcacaaaagatgtgcagaagtgtgttacccatggagaattgtcaccgaagagaatcctgacaccattagtctctttgataaagttactatcaccagcaatgttatatattgacatatgcctcctgtaggtacactgagaaaggcatagcatcacttctgtggtatttttgctgggatggagtccacagtgatgctaatctgggaaccacacttgagaaccactgctttattcctagagttagccagtgtgtgttgtaaggtaagaataaaagcaaatgaactattccttcattgtatctcttatctgtccctgacagggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcat

SEQ ID NO: 430598 - DNA, 2811 bp, Homo sapiens
ctaattatcatttcctttgattttggggtgatgtatatgagatgtcctttgtctcttgtaacagtttttacttaattgccatcttgtttgatattagtatatctgttttaacaaaagaactgagcacatttataggatgacggggtcccattaacatgtcataaaggcagatgagatgaaatcagtggcactgaaacaacctggctttataaacagaaggtagtatctgcagcccctaaaggtgaaggaaagctgggatgaacacaagtgatggatgtaggtgggtaccaaatgctgactgagcttagctttttcagcctcagaggcaccttggtgaatgaatggggtgaccctctcagaagggctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaggacactgatgactggctgtgcgtggattttggtaagttattctggcgtattttacaggtaactgttggtactacgctaatcttgaattgttttcagttgcaaaaggattgagatcaaattgatgaatgtatttccaggtaagatttttgaagtgtgtttaaggtaacaaaagtttttttagttataatccaggtgctcttattcacatgtagaattttcacctaaccaaaccaaagtaccctagatgatgccctcctggaggaagatatatactacatggtgtgtatctactagccacacagatcaggaaggtggtggacaacaggataacatagtagaggcgggagagattccttagtagtggtagaggaaggtttgggggctgtggtgcataaatgagatgaggatgaggttattccaggcacaaaaaaggacaagagcagaagactagaattttgaaaagatctaacaactttgggtattaatgtgtacatagtttcaaagcacctcccaacaagataatatttacaaaggggaaacataactgtatgtcaagaactgaggagtctgagattttattctgcttgtaagctaatacattgtcccgccagttttcatggacactggtaaaagacaagactattagagggttagagacaaagaacagtttattactcacagcagtagccagcatccattttgcactggtttcctgagctctggattccatagggcaacatgggccagatgacaccagcacacacagttgtaaaactggaactcagatgagggtgtctaggttttttataactggcaggaagcaggcctacttttgctctgatggtttctcacttttgtcgctattaacgttttggaccaggtaattttgcatgtgggggaggggtgtctcttgtgcacggtacgatgtttagcagtatcctcccttctccaattgtgacaatcaaaaatgactctaaacattaccattattacctaattgagaaatgctgctgtaagcaaagctgccctttgccctggagggaggcagtatctttctgttaagaatattcacgatacaaacattcttggatagtcaaaacaaaaggcagtcagtgtttttgcacaaaagatgtgcagaagtgtgttacccatggagaattgtcaccgaagagaatcctgacaccattagtctctttgataaagttactatcaccagcaatgttatatattgacatatgcctcctgtaggtacactgagaaaggcatagcatcacttctgtggtatttttgctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaggacactgatgactggctgtgcgtggattttggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcatttcagatttggattgagtcacttattggaaaatacagctcctaaagtccgtctccttggttaggctgctcttaggacaaggcttgtgtacctcatgggcactcctgctaactggcatgcagagactgtcgataagtgagctatacctgcaaccaaaaatcagtacattctacccaaaacttatgacacgctgcctttatcctggaaatgtcatcagaatttcctggagttagcactggctcctgtgcttgacttctctgctcagatttttattaatttaatttagcttaaatgtaaatcttaaccctgtttgtttaatggaatggcaaaaattttaaaaaataatataaaacatagcccactggtcttatttttatac

SEQ ID NO: 430599 - DNA, 2433 bp, Homo sapiens
ctaattatcatttcctttgattttggggtgatgtatatgagatgtcctttgtctcttgtaacagtttttacttaattgccatcttgtttgatattagtatatctgttttaacaaaagaactgagcacatttataggatgacggggtcccattaacatgtcataaaggcagatgagatgaaatcagtggcactgaaacaacctggctttataaacagaaggtagtatctgcagcccctaaaggtgaaggaaagctgggatgaacacaagtgatggatgtaggtgggtaccaaatgctgactgagcttagctttttcagcctcagaggcaccttggtgaatgaatggggtgaccctctcagaagggctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaggacactgatgactggctgtgcgtggattttggtaagttattctggcgtattttacaggtaactgttggtactacgctaatcttgaattgttttcagttgcaaaaggattgagatcaaattgatgaatgtatttccaggtaagatttttgaagtgtgtttaaggtaacaaaagtttttttagttataatccaggtgctcttattcacatgtagaattttcacctaaccaaaccaaagtaccctagatgatgccctcctggaggaagatatatactacatggtgtgtatctactagccacacagatcaggaaggtggtggacaacaggataacatagtagaggcgggagagattccttagtagtggtagaggaaggtttgggggctgtggtgcataaatgagatgaggatgaggttattccaggcacaaaaaaggacaagagcagaagactagaattttgaaaagatctaacaactttgggtattaatgtgtacatagtttcaaagcacctcccaacaagataatatttacaaaggggaaacataactgtatgtcaagaactgaggagtctgagattttattctgcttgtaagctaatacattgtcccgccagttttcatggacactggtaaaagacaagactattagagggttagagacaaagaacagtttattactcacagcagtagccagcatccattttgcactggtttcctgagctctggattccatagggcaacatgggccagatgacaccagcacacacagttgtaaaactggaactcagatgagggtgtctaggttttttataactggcaggaagcaggcctacttttgctctgatggtttctcacttttgtcgctattaacgttttggaccaggtaattttgcatgtgggggaggggtgtctcttgtgcacggtacgatgtttagcagtatcctcccttctccaattgtgacaatcaaaaatgactctaaacattaccattattacctaattgagaaatgctgctgtaagcaaagctgccctttgccctggagggaggcagtatctttctgttaagaatattcacgatacaaacattcttggatagtcaaaacaaaaggcagtcagtgtttttgcacaaaagatgtgcagaagtgtgttacccatggagaattgtcaccgaagagaatcctgacaccattagtctctttgataaagttactatcaccagcaatgttatatattgacatatgcctcctgtaggtacactgagaaaggcatagcatcacttctgtggtatttttgctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaggacactgatgactggctgtgcgtggattttggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcat

SEQ ID NO: 430600 - DNA, 995 bp, Homo sapiens
gccgacgcaaggctgctgctatggggccgggcggccgtgtggcgcggctgctcgccccactaatgtggcgcagggcggtttcctcggtggcggggtccgcggttggagccgagcccgggcttcggctgctggccgtgcagcggcttcccgtaggagcagcgttctgccgggcttgccagaccccaaactttgtccgcggcctgcacagcgagcctgggctggaggagcgggcggaggggacggtcaacgagggacgcccagaatcggacgcggcagatcatactggtcccaagtttgacatcgatatgatggtttcacttctgaggcaagaaaatgcaagagacatttgtgtgatccaggttcctccagaaatgagatatacagattactttgtgattgttagtggaacttctacccgacacttacatgccatggccttctacgttgtgaaaatgtacaaacacctgaaatgtaaacgtgaccctcatgttaagatagaagggaaggacactgatgactggctgtgcgtggattttggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcataaaaaaaaacaaggggggcgcaaaatacccgcaagggcccaggttagcttcccagttttggcaagggcccaaagggagcggattaagcagcatggcgggttcaacgcggaaggaaacggctggactgggaggaccccttgggggcaaatgcacccccgcatacagccggaaatggtaaggacaccttcggggatttgttatacatcagaaaagacacacagacagagggaacacaaacagaacc

SEQ ID NO: 430601 - DNA, 982 bp, Homo sapiens
ctaattatcatttcctttgattttggggtgatgtatatgagatgtcctttgtctcttgtaacagtttttacttaattgccatcttgtttgatattagtatatctgttttaacaaaagaactgagcacatttataggatgacggggtcccattaacatgtcataaaggcagatgagatgaaatcagtggcactgaaacaacctggctttataaacagaaggtagtatctgcagcccctaaaggtgaaggaaagctgggatgaacacaagtgatggatgtaggtgggtaccaaatgctgactgagcttagctttttcagcctcagaggcaccttggtgaatgaatggggtgaccctctcagaagggctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaggacactgatgactggctgtgcgtggattttggtaagttattctggcgtattttacaggtaactgttggtactacgctaatcttgaattgttttcagttgcaaaaggattgagatcaaattgatgaatgtatttccaggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcat

SEQ ID NO: 430602 - DNA, 924 bp, Homo sapiens
gccgacgcaaggctgctgctatggggccgggcggccgtgtggcgcggctgctcgccccactaatgtggcgcagggcggtttcctcggtggcggggtccgcggttggagccgagcccgggcttcggctgctggccgtgcagcggcttcccgtaggagcagcgttctgccgggcttgccagaccccaaactttgtccgcggcctgcacagcgagcctgggctggaggagcgggcggaggggacggtcaacgagggacgcccagaatcggacgcggcagatcatactggtcccaagtttgacatcgatatgatggtttcacttctgaggcaagaaaatgcaagagacatttgtgtgatccaggttcctccagaaatgagatatacagattactttgtgattgttagtggaacttctacccgacacttacatgccatggccttctacgttgtgaaaatgtacaaacacctgaaatgtaaacgtgaccctcatgttaagatagaagggaaggacactgatgactggctgtgcgtggattttggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcataaaaaaaaaagcaaaaaaacacacaaaaacccggcgacatttcgggggcacaaaggatcaaaacgcactggcaaggtcccgccctttgaaagggaaccgggccccaaaggaaacaacgacctaaaaaacaaaccccaccaccgcaacataacacacacacacaccccacacaa

SEQ ID NO: 430603 - DNA, 286 bp, Homo sapiens
  misc_feature (71)..(72): n is a, c, g, or t
  misc_feature (82)..(82): n is a, c, g, or t
  misc_feature (84)..(84): n is a, c, g, or t
  misc_feature (88)..(88): n is a, c, g, or t
gctttttggacacttctctatgtaaaaggggtaagtcaccttttaaatgtaaaccactgggaaatatttgnncagccttgantnatanaaaaatgccgcagaatgatgcctggggaacacccaatttcccggttttatggaaaaaaaaaaaaaaaaaaaaaaaaaagcttgtttcgtcaccatagaggcagctgccagagtctacacagcagaattttaaacttaagatatagtaaaatcttaccccaccaataggatatttaccaagaagaaactaaaaaaaaaa

SEQ ID NO: 430604 - DNA, 464 bp, Homo sapiens
  misc_feature (311)..(311): n is a, c, g, or t
  misc_feature (315)..(315): n is a, c, g, or t
  misc_feature (318)..(318): n is a, c, g, or t
  misc_feature (324)..(324): n is a, c, g, or t
  misc_feature (333)..(333): n is a, c, g, or t
  misc_feature (344)..(344): n is a, c, g, or t
  misc_feature (346)..(346): n is a, c, g, or t
  misc_feature (350)..(350): n is a, c, g, or t
  misc_feature (352)..(352): n is a, c, g, or t
  misc_feature (357)..(358): n is a, c, g, or t
  misc_feature (362)..(362): n is a, c, g, or t
  misc_feature (426)..(426): n is a, c, g, or t
  misc_feature (432)..(432): n is a, c, g, or t
  misc_feature (434)..(434): n is a, c, g, or t
  misc_feature (437)..(437): n is a, c, g, or t
  misc_feature (446)..(446): n is a, c, g, or t
gcgatctagaggaccctgctgctgactatttgttgtgtttttcaatttttaagtgtttgtattttatgtcaacctcctcagtgaaggtcatacagtataaacagccatactatacagccatatatctgaaaactttcttggcttaattgtgcttctagaacattctaaatgaaaagggttaatgtcatttaaaaagtaaagcaatggaaattattagcatgctttgatttatagataatggctaagattgatgcttggtaaaaccctaattttcctgttttaatgaaaaaaaaaaaaaaaaaaaaaggttngttncgnccccanaggggcggntgccaagtctncncggnanatttnnaacntaaggttttggtaaatttttccccaaaaattgggtttttcccaaggaagaaccttaaaaaacanaacaananttncgggggggnttccactttccaccaatt

SEQ ID NO: 430605 - DNA, 237 bp, Homo sapiens
ccactggggaattattttcaacgctcgtggtttatataaaaaaaggcctaaaatgatagcctgggggaaccctaatttcccgtttttatatgaaaaaaaaaaaaaaaaaaaaaaaaagcttgtttcgtcaccatagaggcagctgccagagtctacacagcagaattttaaacttaagatatagtaaaatcttaccccaccaataggatatttaccaagaagaaactaaaaaaaaaa

SEQ ID NO: 430606 - DNA, 1222 bp, Homo sapiens
  misc_feature (1184)..(1184): n is a, c, g, or t
  misc_feature (1190)..(1190): n is a, c, g, or t
  misc_feature (1192)..(1192): n is a, c, g, or t
  misc_feature (1195)..(1195): n is a, c, g, or t
  misc_feature (1204)..(1204): n is a, c, g, or t
tactctttttaggctaaaaacctgaaaggaaaccatttctattacagcgagaataattcacccttagaagtccagttttcttccttttttgaaataatattgtttgtattaaggtaactgtgttactcctactgcatccaaagctcactaatctctgaggttttaggagatttatctactctcctctaattggtagggttgactttcccaggacattgctaaggttagcccctgaaggcaataatatttaaaaaaataaaaaataaaggattccacatagctccaaaagtcaggtaaaagctggagggaattagagatagcaaggaaagatcaaggattaacttgcaagctctattttctctaatatctggatctaggaaaattgtctaccgccttgtctgctggatcactcatcacctacgcattttataaaaggctacccaaaaagaaattgttaacaaggaatgttaacaagcctttaaaagctaataaacaacagactgtggtgtttgctttcagttactcctggcaagcagaagtaagagcgtaggtcatcaacttcctaggtggctgtagggaacacctcctacagtaagcctatagggacaaaaactggtatgggaatcacaagtgtgagcaccattatcattaccttcctccacatgctctcatttgtggaaaaattaatctaggcctctcgaaaaccctatggaatctgccttttcatgtccaggaaccctgtgggctttttctgattgctgcttgatagtgctaacctatttgttgtgtttttcaatttttaagtgtttgtattttatgtcaacctcctcagtgaaggtcatacagtataaacagccatactatacagccatatatctgaaaactttcttggcttaattgtgcttctagaacattctaaatgaaaagggttaatgtcatttaaaaagtaaagcaatggaaattattagcatgctttgatttatagataatggctaagattgatgcttggtaaaaccctaattttcctgttttaatgaaaaaaaaaaaaaaaaaaaaaaaaaaagcttgtttcgtcaccatagaggcagctgccagagtctacacagcagaattttaaacttaaggttttggtaaatttttccccaaaaattgggtttttcccaaggaagaaccttaaaaaacanaacaananttncgggggggnttccactttccaccaatt

SEQ ID NO: 430607 - DNA, 471 bp, Homo sapiens
  misc_feature (433)..(433): n is a, c, g, or t
  misc_feature (439)..(439): n is a, c, g, or t
  misc_feature (441)..(441): n is a, c, g, or t
  misc_feature (444)..(444): n is a, c, g, or t
  misc_feature (453)..(453): n is a, c, g, or t
gcgatctagaggaccctgctgctgactatttgttgtgtttttcaatttttaagtgtttgtattttatgtcaacctcctcagtgaaggtcatacagtataaacagccatactatacagccatatatctgaaaactttcttggcttaattgtgcttctagaacattctaaatgaaaagggttaatgtcatttaaaaagtaaagcaatggaaattattagcatgctttgatttatagataatggctaagattgatgcttggtaaaaccctaattttcctgttttaatgaaaaaaaaaaaaaaaaaaaaaaaaaaagcttgtttcgtcaccatagaggcagctgccagagtctacacagcagaattttaaacttaaggttttggtaaatttttccccaaaaattgggtttttcccaaggaagaaccttaaaaaacanaacaananttncgggggggnttccactttccaccaatt

SEQ ID NO: 430608 - DNA, 1183 bp, Homo sapiens
tactctttttaggctaaaaacctgaaaggaaaccatttctattacagcgagaataattcacccttagaagtccagttttcttccttttttgaaataatattgtttgtattaaggtaactgtgttactcctactgcatccaaagctcactaatctctgaggttttaggagatttatctactctcctctaattggtagggttgactttcccaggacattgctaaggttagcccctgaaggcaataatatttaaaaaaataaaaaataaaggattccacatagctccaaaagtcaggtaaaagctggagggaattagagatagcaaggaaagatcaaggattaacttgcaagctctattttctctaatatctggatctaggaaaattgtctaccgccttgtctgctggatcactcatcacctacgcattttataaaaggctacccaaaaagaaattgttaacaaggaatgttaacaagcctttaaaagctaataaacaacagactgtggtgtttgctttcagttactcctggcaagcagaagtaagagcgtaggtcatcaacttcctaggtggctgtagggaacacctcctacagtaagcctatagggacaaaaactggtatgggaatcacaagtgtgagcaccattatcattaccttcctccacatgctctcatttgtggaaaaattaatctaggcctctcgaaaaccctatggaatctgccttttcatgtccaggaaccctgtgggctttttctgattgctgcttgatagtgctaacctatttgttgtgtttttcaatttttaagtgtttgtattttatgtcaacctcctcagtgaaggtcatacagtataaacagccatactatacagccatatatctgaaaactttcttggcttaattgtgcttctagaacattctaaatgaaaagggttaatgtcatttaaaaagtaaagcaatggaaattattagcatgctttgatttatagataatggctaagattgatgcttggtaaaaccctaattttcctgttttaatgaaaaaaaaaaaaaaaaaaaaaaaaaaagcttgtttcgtcaccatagaggcagctgccagagtctacacagcagaattttaaacttaagatatagtaaaatcttaccccaccaataggatatttaccaagaagaaactaaaaaaaaaa

SEQ ID NO: 430609 - DNA, 807 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430610 - DNA, 608 bp, Homo sapiens
  misc_feature (550)..(550): n is a, c, g, or t
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagncacacttttctgattaaacgactgatccgtccttgggtggtggatgcgcccctggcct

SEQ ID NO: 430611 - DNA, 989 bp, Homo sapiens
taacagccttcttcattttcaccattagaacacttaacactataacataactaaccaggagtaagagttggggccgagaggagagtgcagtctggacatttgaggtgcttgctctaaagtaggttatggagctgagctgacttcaggaaaagccaactgctccaggttctctcactggggttcagagagtggagtggcctgccagagctccaggtagctgtggatgcggggagatgaacagccagcagagctaggcaaacatgaagatgtaaaaccaggttaaaatggcaacttttcagccaaggacatgatagatgcatgtcgtgtccccagggctgcacccaggagaggcctgtgtcctcctgcattgatggggctgcatcttcaggcattagaaacttgaaggcctttccttgttagttccaagttgtactgctagcacacagagcagaggcagggagggagtggcatttacaggccgtccttgaacggctgagtgggagctgcccgggtgatgctgtgaggcagggccttcctgtgctccctgaacctccagcgtgaacaaggagtgaatgctgcagagcagctccatgatgggcccaggtagcaaagggaggagctcacaaggcctgtcttggtgatgtgggcctggggtattttaactctggaagtttctgttttgctttatctaaattgaaaggatggttttgcctttcagcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430612 - DNA, 332 bp, Homo sapiens
agggagatgaagtcgcttgcccaaagtcatacgagcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagagatcatattatgttcactgtctttta

SEQ ID NO: 430613 - DNA, 159 bp, Homo sapiens
tcgaattcaagcttctaacgatgtacggggacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430614 - DNA, 945 bp, Homo sapiens
  misc_feature (818)..(818): n is a, c, g, or t
  misc_feature (824)..(824): n is a, c, g, or t
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagacagaaaaaaancaacanaaacaaaacaaacacacacaaaccagaagaggacacaaagtccggggacggcacaaaaaagggaaagaaaggagccaatgagacaaaaggaagcaccacggacccaagtcgcgggcaaccg

SEQ ID NO: 430615 - DNA, 1399 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgagagaaaggtggtcctgagagccagtgggaggatccctcctgggatgaccggtaccaaacctcgagcaccagggtgcgatgcttcggctggggaagtctggcagtcttcaaggttatgggacctggcgagtgggagcgactcaggacgacccagcgtttgtcccccgggatgcctacggggcagtaggcgcggggctgcgcgtgccgtaaccttggcgtcttccgagcacagcccctggaagctgctagcctgaggggcgcaggagagggggtctgcccttcgctgaattccggggaaggggcatggactagcccccaaatcagcttcctttgccattgtggtaaaacctgtcagagatcacttactagtaatgctaaggaatatttgtaaaacacatttcacagttttataaataaaatgaggccgaaaagtttaaatgagtctttggctgctcagtcagtaagtggtagaattgagatttgaacccacggaatcacccagaagatcgagtttgaaaaaatgttatgctgtttgtgctgcatctcaccatggtgctttacatatcatgaccccttcctggcatcttaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430616 - DNA, 761 bp, Homo sapiens
gagagagagagagagagagagagagagagagagagagagagagagagagagagagagagcagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430617 - DNA, 926 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagaaaaaaaaaaaaaaaaaaagcggggggtttttgggggggggaaaagggtttaaggggctgggaattttcctgccactttttgaagggggactgccggccccaaggaggaattaaaccgtc

SEQ ID NO: 430618 - DNA, 863 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagagttttataaagtggggaatagcaatggagtgcaaatgagatacaaagggggtacaa

SEQ ID NO: 430619 - DNA, 1510 bp, Homo sapiens
  misc_feature (858)..(858): n is a, c, g, or t
  misc_feature (1510)..(1510): n is a, c, g, or t
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagaaaaaaaaaaaaaaaaaaagaaaaaaacaacactgtgtgtgtgggcgcgcgnctggggccctggagaaaagagagtttcatagaaaccacattgcgcgtgtgtgggcgcgcgcgggggggcccccatgtggtgtgtataggtggaaccccgtgtggccatagagcggggttcccacaaagaggagaagaccgcggggcgccaatggagccaagagcggcgcgggggggttctcttacacgaatatatatagaaaagcgcgccgggggggggggacaccccgagagcggggcttccggggaccaaattctccgagagaggggcgagtgctccggggagggggccaacataacgggcggagaggcgctctatatactacagacggaggggagcgcgctccaacacggcgagagagcgctcggcagatgtatcttgtcaaaaaaaatttaacaggcccccgcgagccgagccccgcgcgggtggggggggtgacacaccaggcagtacagcagtacctgcagaaaaaagagaataccagatgagaacacgacgcaccaaacggtatgacgagccgagcgagcaagcagcagtcgagaggcatacgacagagaagacgacagataaggtatgcataggcgcacacaggatcgcgaggcacaatggggaaaaagcaacacaatacacggcaaaacaacgcgcaagaaan

SEQ ID NO: 430620 - DNA, 1309 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagataaaaaacaacacaaaaaacaccaaacaaaacaacaaattggtgggggcgggcttggggccctcgggagaaggtttttcttaacaacccacttctcggtctggggcggggggggcccccagttggttttcgtgcgcaccccggggccccaaggggtggctccctacaggagaagacccgtggcccaagcgaccatggcggctgtggtatttctctccaccatatagaaaacggccggggggggccacaggggcggggtccggcaccaaatctcccagagggcgggttcggaggcaccaacgatgggccctataccacgggggggcccaagcgcgaagcccgatataaaaattagccgcggcgctggggcagaaatgactaaacgacacgaaccgacgtccagcaacacagaccctcaccagtcgagcaagacagaccgcccaccagagaatcgacatatcacccacagacacgaccggcaccagacaacgtaaccactaccc

SEQ ID NO: 430621 - DNA, 1537 bp, Homo sapiens
  misc_feature (1410)..(1410): n is a, c, g, or t
  misc_feature (1416)..(1416): n is a, c, g, or t
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgagagaaaggtggtcctgagagccagtgggaggatccctcctgggatgaccggtaccaaacctcgagcaccagggtgcgatgcttcggctggggaagtctggcagtcttcaaggttatgggacctggcgagtgggagcgactcaggacgacccagcgtttgtcccccgggatgcctacggggcagtaggcgcggggctgcgcgtgccgtaaccttggcgtcttccgagcacagcccctggaagctgctagcctgaggggcgcaggagagggggtctgcccttcgctgaattccggggaaggggcatggactagcccccaaatcagcttcctttgccattgtggtaaaacctgtcagagatcacttactagtaatgctaaggaatatttgtaaaacacatttcacagttttataaataaaatgaggccgaaaagtttaaatgagtctttggctgctcagtcagtaagtggtagaattgagatttgaacccacggaatcacccagaagatcgagtttgaaaaaatgttatgctgtttgtgctgcatctcaccatggtgctttacatatcatgaccccttcctggcatcttaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagacagaaaaaaancaacanaaacaaaacaaacacacacaaaccagaagaggacacaaagtccggggacggcacaaaaaagggaaagaaaggagccaatgagacaaaaggaagcaccacggacccaagtcgcgggcaaccg

SEQ ID NO: 430622 - DNA, 839 bp, Homo sapiens
  misc_feature (711)..(711): n is a, c, g, or t
  misc_feature (727)..(727): n is a, c, g, or t
  misc_feature (778)..(778): n is a, c, g, or t
  misc_feature (789)..(789): n is a, c, g, or t
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattccacaaaacntggggcaaggggtatnccggggaaaattgtctaaaaaaattgtttgggtttttcctgcccatccaanttgaaaaattnccttaaaacttggggagccaaccaaattaaaaaaagctttcccaaaaaaa

SEQ ID NO: 430623 - DNA, 1101 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagggtaggttttaaattatttatggtacgttttctcgggttattttaagcttaaaatggctacagaaagtactagtgaaatattagatctaactctatactaatttttctgtagttaaaattttgtatttattttaaatttaaatgattatctgactgtgcagttttacttttgcctttttctaggtgtaattataacctcttacatttgtgcaacacatttagcctttcaaaacacttttttgtgtgtcccatttgattagcgcgttttcacatttccagtcttacttcttttgtactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430624 - DNA, 676 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaaggctaagactgatccgtcaatcttggtactacgcttgacagtaccgagtcgatt

SEQ ID NO: 430625 - DNA, 617 bp, Homo sapiens
  misc_feature (550)..(550): n is a, c, g, or t
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagncacactcatcatggtagaaaaggcagaaacgagtccttgggtactgcgccatggaagattatcgaga

SEQ ID NO: 430626 - DNA, 755 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcacttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430627 - DNA, 1283 bp, Homo sapiens
taacagccttcttcattttcaccattagaacacttaacactataacataactaaccaggagtaagagttggggccgagaggagagtgcagtctggacatttgaggtgcttgctctaaagtaggttatggagctgagctgacttcaggaaaagccaactgctccaggttctctcactggggttcagagagtggagtggcctgccagagctccaggtagctgtggatgcggggagatgaacagccagcagagctaggcaaacatgaagatgtaaaaccaggttaaaatggcaacttttcagccaaggacatgatagatgcatgtcgtgtccccagggctgcacccaggagaggcctgtgtcctcctgcattgatggggctgcatcttcaggcattagaaacttgaaggcctttccttgttagttccaagttgtactgctagcacacagagcagaggcagggagggagtggcatttacaggccgtccttgaacggctgagtgggagctgcccgggtgatgctgtgaggcagggccttcctgtgctccctgaacctccagcgtgaacaaggagtgaatgctgcagagcagctccatgatgggcccaggtagcaaagggaggagctcacaaggcctgtcttggtgatgtgggcctggggtattttaactctggaagtttctgttttgctttatctaaattgaaaggatggttttgcctttcagcctttagaagaagccacactctctgaattaaaaactgtcctcaagagcttcctaagtcaaggccaagtattgaaattggaggctaagggtaggttttaaattatttatggtacgttttctcgggttattttaagcttaaaatggctacagaaagtactagtgaaatattagatctaactctatactaatttttctgtagttaaaattttgtatttattttaaatttaaatgattatctgactgtgcagttttacttttgcctttttctaggtgtaattataacctcttacatttgtgcaacacatttagcctttcaaaacacttttttgtgtgtcccatttgattagcgcgttttcacatttccagtcttacttcttttgtactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430628 - DNA, 681 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcagtaagtagctttcctattcattacatatgaagttcctgtttgtatattttttcctttggttgtttgtgcattcctaatgaggtgtatcctacaagaaaaaactgggaaaaagccattgtctgtaaacacatttttagtaataatattgggtttttattataagacatataaaaagaacaaacagatacatataaggatattaatattaggaaccaagattaggggctaagaaaaggtagaaatataagattaaaatggatggtaatttaggaaaattgctatttcagaagagaatttaaaagctacctttaaaaatctatgcttataactgggcacagtgctcacgcctgtaatcccagtactttgggaggctgaggcaggcagatca

SEQ ID NO: 430629 - DNA, 833 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagagatcatattatgttcactgtctttta

SEQ ID NO: 430630 - DNA, 717 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430631 - DNA, 931 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggagtgattgtgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctgcgcacgggcgacgctgctgtgtgtggtctcagaggctctgcttccttaggttacaaagcaaaaca

SEQ ID NO: 430632 - DNA, 754 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaaactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430633 - DNA, 677 bp, Homo sapiens
tcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 430634 - DNA, 784 bp, Homo sapiens
cagccgcccgggagaagatggctgccccagcagtgtccgggctctcccggcaggtgagagaaaggtggtcctgagagccagtgggaggatccctcctgggatgaccggtaccaaacctcgagcaccagggtgcgatgcttcggctggggaagtctggcagtcttcaaggttatgggacctggcgagtgggagcgactcaggacgacccagcgtttgtcccccgggatgcctacggggcagtaggcgcggggctgcgcgtgccgtaaccttggcgtcttccgagcacagcccctggaagctgctagcctgaggggcgcaggagagggggtctgcccttcgctgaattccggggaaggggcatggactagcccccaaatcagcttcctttgccattgtggtaaaacctgtcagagatcacttactagtaatgctaaggaatatttgtaaaacacatttcacagttttataaataaaatgaggccgaaaagtttaaatgagtctttggctgctcagtcagtaagtggtagaattgagatttgaacccacggaatcacccagaagatcgagtttgaaaaaatgttatgctgtttgtgctgcatctcaccatggtgctttacatatcatgaccccttcctggcatcttaggtaattttttcataagcattaaaaagtcttaatcctcacaagcagttttgataaaacacgttccatagctggagtatttgaaggtgacctgtgatctgtgacctgtgcgcttgcaggtgatttttaaactgtgtattcc

SEQ ID NO: 430635 - DNA, 3572 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430636 - DNA, 4879 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaatatggatttgttaattttacctttttttttctttccaactttaggttcaagggttgttacatgggtaaattggatcataggg

SEQ ID NO: 430637 - DNA, 498 bp, Homo sapiens
tgggtgcctagaggatcccagttcgacggagactctcacattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtctccgtcgaactgggacctctagatcgacct

SEQ ID NO: 430638 - DNA, 912 bp, Homo sapiens
  misc_feature (871)..(871): n is a, c, g, or t
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccagatatatttatcaattcctggaaaaaatagtggagacaacactgagaaacttactcaacatttccacaagctactcgttcatggaagtcgcataacagcttaggagtttgctttaaccagagtatgtgtgcataaaaaatacatcttcctgaggtagttggcagcgtaatggcagcataaaggcaagctggattctctctctgctgactcacacaagaaacaaaaagaaatatacaacatggagatcttcagcaacagtccagagctcaagtatgaagatgaaacaattcctggggncacaaagatgtggaagcagatggtaggggaacagacttcca

SEQ ID NO: 430639 - DNA, 4797 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaa

SEQ ID NO: 430640 - DNA, 3826 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtcatgggtgagacccattgaagccccatccagtcctgagaggcaaagcaaagaacccaggtcacagcgatgaagtggacggccaggcctgtgtgctgtggggctcttccatggagcagggagccatgtcctataagtaccgcatgctaaccgattgcgccactggagccacaccatgtcatgatgtacctgtaacattcgcaacttgagtttcaaacactaaagtttctgaaacctccatctaatgagtttaagtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430641 - DNA, 5448 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaaaaaaaaaaaaaaaaaaaaaaaaaaaaaaaaaaaaaaagggggggcccctaaaaatttccccggggggcccaatttgtttccccctttttttgaaaagggggcccctaatgagagactacgatatatataaagcaagaggcaaggggcgcgcgttttaacagagttgctgcgttggggaaacacagtgtgacctgtgggggatatctggtggtgaggagggaccccttaatttcgtggggggtgttgaaccattagttgcggaccaacattaacttaacagaaaattaaagagcttcagaggggaacattattaaaacatctttgcagggtgttctatatgctggtctcaccagaggactaattagtgactagcaggacatagaaaaagtttgggggataaccggggagtttttgattttatgaaacaatttttttcccgggggtagcttaggtgtatataaaatgggtcatgcatataacagatacaataccacaacaaattcagaataagagagaaaaatacgatcgagagaaatataataaaagtagaatagtatatgaagaacaataaagagaaactagtatatgataatagatgtgacgaataagataaaagaaacaacaaaagaaaacaatagggagaaaaatcaa

SEQ ID NO: 430642 - DNA, 3575 bp, Homo sapiens
  misc_feature (2697)..(2697): n is a, c, g, or t
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatccttcgagnacgctatgacccctgatacccaccccgagctcggtacccatctcgacgtagactctcagactctgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430643 - DNA, 3125 bp, Homo sapiens
agtagtcttaagatcgctgaggcgggggaccggtccatggttcactaggaggcggaagctcctaggagcatgttgctggatgtctgctgaatgtcccataagggaaccaaacaaattcgttgcgccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430644 - DNA, 3527 bp, Homo sapiens
ctatcagctgaaagcctgaagagcgcagcagagctcccctgaagtagaagaaatttctccgatggacagcagctgcactcagtttctggagagttccacattggcctgctatgtggatttcagactggcctagccagcccccacaatcatgattcaggagcagttccagaaaaatcccgacagttacaatggtgctgtccgagagaactacacctggtcacaggactatactgacctggaggtcagggtgccagtacccaagcacgtggtgaagggaaagcaggtttcttttatgcctcctcagggaacaggtgtcaggctgtgggcctttgttcccctcagcaacaaacacaaaatttatttttcttcagctacaaacacccggtcacccccctttaaactacatcaggtcatgggtgagacccattgaagccccatccagtcctgagaggcaaagcaaagaacccaggtcacagcgatgaagtggacggccaggcctgtgtgctgtggggctcttccatggagcagggagccatgtcctataagtaccgcatgctaaccgattgcgccactggagccacaccatgtcatgatgtacctgtaacattcgcaacttgagtttcaaacactaaagtttctgaaacctccatctaatgagtttaagtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430645 - DNA, 3164 bp, Homo sapiens
ccagcagttcagttcctcatcctttgaccccagacatataaagcctgtgcattatgacacagcctggagccttttcccaagctataggctcctgtgactactaccagttcctttcctttatgtcatacttgactttgcagatgccattacggcctctccctcacttgagcttcacgtggttgtggaggtatgagagcatgagtgatgcactagtagtactggggccggctagcttgccctctgaaggtgcagccctggccgcctgtattacactagtgagcccgtgatcctggggttgccatctccatggactgagaggtcgtgatagccctgccttaaaacactggccttgactctcctgccttccgttgggtgaactcagtgcagatcatggagcaggtcacgatgctctcaagttggttccctctgagcgaggagctcttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430646 - DNA, 2982 bp, Homo sapiens
ctcggtacccaccactggtgtgctgtacggtgggagtggtgatggtttccaaggtacctgactgcacaccagtggtcaccctgataggagagatgattttcttctgctgtgtccccaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430647 - DNA, 2846 bp, Homo sapiens
tcggggggcggggggcgatcggccggggccagcggaggacgaggggagcgcgggccaggaagggacgccacccagcgagacaacgctgagagtctctctggagtccggagcccgggacgtgcgttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430648 - DNA, 2783 bp, Homo sapiens
gggacagaagatggagggttagaaattcagtctgtggagcagtcttggagagaaattggcaggcacccagtacctcccttggtcgaaggctgctccagggtagtacagttctctggccagccggtcttgccaggcaagtgcctgagccctgaggaagcaagaaggctctctacctgcagtcagagtctgctctgggagaaagtacacagtgcgttgtgatcccctttaatctctctattttctgttgtgtagaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430649 - DNA, 3179 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctagga

SEQ ID NO: 430650 - DNA, 4657 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaa

SEQ ID NO: 430651 - DNA, 3240 bp, Homo sapiens
  misc_feature (3193)..(3193): n is a, c, g, or t
  misc_feature (3206)..(3206): n is a, c, g, or t
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgcacttctggaaacctccctgcactctgggaaacctccctgaacaccctncccaactctgcgntctcagcctccctgcatctctcctggggctccct

SEQ ID NO: 430652 - DNA, 3101 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtctccgtcgaactgggacctctagatcgacct

SEQ ID NO: 430653 - DNA, 3438 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgttgagttgttggttgtctccctcttctttcttcttattaggtttcccccggaggtttggggccccccaatttgggccagggcccacgcaaacccttggttgggggcggtaaagggtccgtttccccaaggaaaaacggttgggaattggcgccaagtgttgcgcgggtggtgtgaggaagcgaattggggcgccgctttataacaaaccccttttttggggttacaaaatctaccggggcggaggaaatatggaaacccatttttcgctgggcaaaagagcacaagggtttattaccaaaaggttatagtgccgacactccagtttatatttcccgccagaaaattgttgtgggcgggtggtcgttgaggggacacccctattttaaacgagggtactcatggggaggttttactcagacgcgtggtcgtttacatataattatgtagtggggacgcacccctgatttgcgggcacaccgctttttgttcgttagcttcaatg

SEQ ID NO: 430654 - DNA, 1690 bp, Homo sapiens
tcttggacgaccgtgtcattcggttcgttgggtccacacactcgagggtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430655 - DNA, 1516 bp, Homo sapiens
tgggctgaagtcgtaattactggcccgtgttgtacaatgcaagaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430656 - DNA, 1872 bp, Homo sapiens
ggggctggaggaccccctcatgcagcaagcttggccccagtgaggaagaagtggggacagggcatggtgccctgtcatggggtgaggactccccaggagattctgtcatgcattaggctgagccctaagtctcataggtcccagcttacccctaagatagcagaatgttggatgttgctcttggaagcaagagagatcactggagaggtagttggttgataagagctaagcagagccttccatggcaagcatgggggcaggctgggttggcccaggacaggtcctggtgtgggggggtgtcatgggtcttggaaaatagcctttcttcatgagagtgggcaaggtgtgcacatggaacaggcactgtcctgagtatccaggacctgctgaagaaggataaaggcatcttccagaatgtcagtcccctcaggtatgtgcctcctagctcttccctgggatatgttagcacaggcagcaaatgcattcccaggcacagagggtcctgccttgggttctggcaccccctcttgtctgtcacctccctttgtgtagttggtccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430657 - DNA, 1077 bp, Homo sapiens
ttaaaaagaactttgaagagagagttcaagaagtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430658 - DNA, 1072 bp, Homo sapiens
cccccgggctgcaggaattcggcacgagtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430659 - DNA, 1216 bp, Homo sapiens
ctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgttccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430660 - DNA, 1013 bp, Homo sapiens
ggtaccccttttttcaccatagggctggttttccccatgtgtgaggagagtctccgtcgaactagttcgacggagactctcacattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430661 - DNA, 2432 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaa

SEQ ID NO: 430662 - DNA, 915 bp, Homo sapiens
tgtctgctgttgcctgcttgaatatcgcggcgatctcactgtcagcccttggcgaacatgcctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430663 - DNA, 1026 bp, Homo sapiens
ttcctacccgtccccggttgctacctcttacccgtccccggttactacctcttatccatctccggccaccacctcatacccatcccctgtgttcacctgcacctcataatccgttcgcccggttgtcacattcccaacctgcctggtgtcgggggcacgagcacaggcaggcctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430664 - DNA, 816 bp, Homo sapiens
  misc_feature (39)..(39): n is a, c, g, or t
  misc_feature (41)..(41): n is a, c, g, or t
  misc_feature (44)..(44): n is a, c, g, or t
  misc_feature (50)..(50): n is a, c, g, or t
cgaaaaaaaaatcaaacaaaaaaaactacggctaggagngngcngggttnacttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430665 - DNA, 786 bp, Homo sapiens
atatctaggaagaatgcaacacttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagca

SEQ ID NO: 430666 - DNA, 1358 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctggtacgagcatggcagtcctggagagtccaccctttaggcccttgtgctggtgacaaggccgatagtggcagaggggttggtgatgacggtggggaagaaggttgtgtggaccagcttcctgccatgtcctagcctagcaaggaacctgtcttacctgctcttgtccccaatcactgcctcacaggtgcactctggtctttcagctgtgttctcatacctgggctgagagcccagttaacaggacctcgaagggtgtcatgagatctgcccttcctgcaccagagcctggtaacatcaagtgtgttgatggcttttgt

SEQ ID NO: 430667 - DNA, 2110 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagaagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaa

SEQ ID NO: 430668 - DNA, 756 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggagcactgctaggatttgctcatgatgcctgaggtataatggacacctgaaatgacagtctgttttaggtgactggattcacatcctcgctatgccgcttcctgaatgtattaccttgaacaagcagtataacctttctgtgtctcagttttcttctctataaaatgtaggtgataataat

SEQ ID NO: 430669 - DNA, 1835 bp, Homo sapiens
ccagcagttcagttcctcatcctttgaccccagacatataaagcctgtgcattatgacacagcctggagccttttcccaagctataggctcctgtgactactaccagttcctttcctttatgtcatacttgactttgcagatgccattacggcctctccctcacttgagcttcacgtggttgtggaggtatgagagcatgagtgatgcactagtagtactggggccggctagcttgccctctgaaggtgcagccctggccgcctgtattacactagtgagcccgtgatcctggggttgccatctccatggactgagaggtcgtgatagccctgccttaaaacactggccttgactctcctgccttccgttgggtgaactcagtgcagatcatggagcaggtcacgatgctctcaagttggttccctctgagcgaggagctcttgacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaa

SEQ ID NO: 430670 - DNA, 756 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtgaggcgggcgggcctgcggtctggggagccgccgcccccggcctgccctgactcctggcgcccgctcctccaagctctcccagcctgtttcctccttttcctggtgtcctggggttgagcttgtgagaatggcttcagtaatttgaagcgcggattggatgtcagcttattccgctgaggtgttcgctccggacgtcctgaggtttcagaagtagtaagccgactgttaagagccctactcagcacccgccagcgcgtacccctcacggtgctgggggccgctagtcagggagcgaaatccatgcaggccagacagaaggaaggacatttacagcaacagaaacgtgcatgccccagaactaccaaagacttgagctggcggggatgacggaggcattgtgttgatcaatgggtgtggtcgcttgtttgaaatgtgacttcccaggtcaaagactgtcaatgtagtgcttattaaaatttctatttgagcttaatt

SEQ ID NO: 430671 - DNA, 727 bp, Homo sapiens
aagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtgaggcgggcgggcctgcggtctggggagccgccgcccccggcctgccctgactcctggcgcccgctcctccaagctctcccagcctgtttcctccttttcctggtgtcctggggttgagcttgtgagaatggcttcagtaatttgaagcgcggattggatgtcagcttattccgctgaggtgttcgctccggacgtcctgagagccctactcagcacccgccagcgcgtacccctcacggtgctgggggccgctagtcagggagcgaaatccatgcaggccagacagaaggaaggacatttacagcaacagaaacgtgcatgccccagaactaccaaagacttgagctggcggggatgacggaggcattgtgttgatcaatgggtgtggtcgcttgtttgaaatgtgacttcccaggtcaaagactgtcaatgtagtgcttattaaaatttctatttgagcttaatt

SEQ ID NO: 430672 - DNA, 2400 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgaacggagtctcatcttgctggagtgcagtggcatggtctcggctcactgcagcctccacctcccaggttcaagcgattctcctgcctcagcctcctgagtagctggtattacaggctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430673 - DNA, 1134 bp, Homo sapiens
  misc_feature (863)..(863): n is a, c, g, or t
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggaaacttcgcagtccagaagaacttttccaagactagagtcttacatcccaaatgctccatggcgtccggcgtgccccgggctggtcccaatctgggggggctccctggtttccctcctttttaagcctctcctgtggtnaccggctcccagtaggtccctcttctgtgaacccgggtcccaggcgcaccccacccagtgagggggactcaccggcgaaaccagagaaggtacgcaatagtgaggaccgaaacacgtagaaactccggacacatcacgtggggacatgaatatatcgcaccatagagagccgatatagagagagggacacacacaacacagagaattccacaatgtgaacagcaaagaacctgagcactgtcacgctctgtcacgagctagcgtcctccgt

SEQ ID NO: 430674 - DNA, 216 bp, Homo sapiens
ggctcacacaaaacagctgacactgactaaggaacctgtgcatttgctcagagatgctacaatttttagatatttctaagacttctggattcttgaggtagttaaggattaaaaccagaaacagtcgaggttttttaaaagcagggttaatgctcccgtaggttaaggctcccggaggttaaggctcccggaggtaaggctccaggatcctctaag

SEQ ID NO: 430675 - DNA, 3124 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430676 - DNA, 2933 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggtggatttcagtgtgttctttggatggcaggccttaagagaagagtcccactgcacagcctcagatacttcatctccatggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430677 - DNA, 3240 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaagcaaggaatagtgtctggagccggtccagctgaaggaagggtgagcagagagtgcaagcaggacccttgtcggtgggtgaacattttgctccaaaagggatccttggccctgcgcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430678 - DNA, 2853 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430679 - DNA, 3303 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaaggtcgtgtacggcccagcgtgggcctgtgccctaactcctcccactcccttactttctgtccttcccgggccctgcagaccggccaagtttagtggtagcctttcctagtgtctcctctttgttaacccttcctacagacacagtgggcagaacttgcctaaagaagaagggaatggaagggctagtggagtcttgttggggagacaaggacctgactgcctgtgggctgcattcgggacacgacacagcagtcaacccatttgcttgtttggtttagcaaggaatagtgtctggagccggtccagctgaaggaagggtgagcagagagtgcaagcaggacccttgtcggtgggtgaacattttgctccaaaagggatccttggccctgcgcaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430680 - DNA, 2765 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtggatttcagtgtgttctttggatggcaggccttaagagaagagtcccactgcacagcctcagatacttcatctccatggctggctgatgttgtgacaccactctggaggttgagctatgaagaacagctcaagcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430681 - DNA, 2530 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430682 - DNA, 2317 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430683 - DNA, 2212 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcaggcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430684 - DNA, 2849 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430685 - DNA, 1973 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgacagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430686 - DNA, 1969 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430687 - DNA, 726 bp, Homo sapiens
gtttgtaagaggatttattggttacgaaggaaggtaaggtggataaatagcccggaaaacctgatttaacccttgctttacagaaaactccctactatgccaaactgtccgcggggcggggaatggaggaggcaggcggggctggagacgggacccgacggtgactgcgcaaggtcgtgtacggcccagcgtgggcctgtgccctaactcctcccactcccttactttctgtccttcccgggccctgcagaccggccaagtttagtggtagcctttcctagtgtctcctctttgttaacccttcctacagacacagtgggcagaacttgcctaaagaagaagggaatggaagggctagtggagtcttgttggggagacaaggacctgactgcctgtgggctgcattcgggacacgacacagcagtcaacccatttgcttgtttggtttagcaaggaatagtgtctggagccggtccagctgaaggaagggtgagcagagagtgcaagcaggacccttgtcggtgggtgaacattttgctccaaaagggatccttggccctgcgcaggtgagacctaccacatagtctctttgatttgaacctctctgagcacaggagagttagcctgccttcctatttgggctactctggactccaggactcttcctgatcaattcctgaggcaggtatagaacagtcgagcacgactgctcacacgctttttttt

SEQ ID NO: 430688 - DNA, 136 bp, Homo sapiens
tctgagaggctctcttgtcttctccatcctattataccctctgtaagcccccacctccctattccttatctattaaggccccttaatgctaataacatcagctgatatttactgggtacttgctagggaccaggcc

SEQ ID NO: 430689 - DNA, 662 bp, Homo sapiens
agggaaagagatttgtcacagaaatatatccagagatttgaactctttcctggaggacagagactatattttcctcatctctttattttgggaaccgaaacataccttgcatacagtaattcagttctgctcaacaggcttgcttttactgtctgctgtgtgccagcattctgctaggcgcttcagttccataagggtttataagtggatgaatgggtttgatagttgtgcttctatttcccaacctctgtatgtgtacctttcatgcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggtaaaggccaggctgatgtcctctctccttagcaggtctcaatctgtacatctgctgaaattctgtattcctagtgtaactaatgtagcattacaaggatttgaggggccacctgaggtag

SEQ ID NO: 430690 - DNA, 1290 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgatttttcaaggatacatttcccgattaaccctcttcgtgccagactcgcgcatcccgaacggggaagaacgaaacgaagagaccgagaccacgcagagaaactgaacagaacggcgacgcgaagaataggcgaaaaacaaccagagcatggacacatgagccccacagaagccacgaggagaagcataggaacaagcagcagaagtccaagcaagcgcgagagaagacagagcaaaccaggagaagcagactac

SEQ ID NO: 430691 - DNA, 3091 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430692 - DNA, 2789 bp, Homo sapiens
ggaaacctttctaatgtggcctcagaagagtggaatttaatttatggcaggggttagcagactacagcttttaggccaattctgtcttgctgcctgattttgtaaataaagttttattggaacacagccaagctcacttgtttatgtattgtctatggctgcttttgcactatgatggcagagttgagtagttgcaacagggaccatatggcctgcaaagccctaaattatttactctttggctcttgacataagtagtttgttgactcctgctttatggcaagattggaactccccttctatggactgtcttgatcttcttagccacagactttcacatatgccataccctccaagcaaaccttatttgtcctcatccagagaacattcctgctttccctttattgttatcttccttggtttcatttgacctctcatccccctcctgtccttctgccctctccagcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430693 - DNA, 2798 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430694 - DNA, 2669 bp, Homo sapiens
tcgacccacgcgtcgggacccacgcgtacgggcgactcaggttggtaagaggatttattaggttacagaagggaaggtggatttcagtgtgttctttggatggcaggccttaagagaagagtcccactgcacagcctcagatacttcatctccatggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430695 - DNA, 2563 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430696 - DNA, 2167 bp, Homo sapiens
  misc_feature (6)..(6): n is a, c, g, or t
gggagnaaacaaaactaggctaggtacgaggcgggtggtgaatcggccgaggcctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430697 - DNA, 2838 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggtggatttcagtgtgttctttggatggcaggccttaagagaagagtcccactgcacagcctcagatacttcatctccatggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430698 - DNA, 1918 bp, Homo sapiens
cccggggaggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgaacggagtctcatcttgctggagtgcagtggcatggtctcggctcactgcagcctccacctcccaggagaatcacttgaacctggggggcggaggttgcagtaagccgagatcgcgccttgcactccagcctgggcaacaagagtgaaactctctccccccgaaaaaaaagaaattaaaaatacatccttgaggaacttta

SEQ ID NO: 430699 - DNA, 1667 bp, Homo sapiens
cttcctgcttctgccgcgtcctgcttcgcctgcttcctgcttctgccgcttcctgcttctgctgcttcctgcttctgccaaatggctgcttcctgcttctggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatggagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgggctgagattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgtaaataaatact

SEQ ID NO: 430700 - DNA, 4896 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattggccaggcatggtggtgcatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgattt

SEQ ID NO: 430701 - DNA, 3490 bp, Homo sapiens
gcaaattcagagacacacataagaaactggaagaagagaaaggcaaaaaggaaaaagaaagacaggaaattgagaaagaacggagagaaagagagagggagcgtgaaagggaacgagaaaggcgagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaaaaaaaaaaaaaaaaacggaagcagaggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtagtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttc

SEQ ID NO: 430702 - DNA, 831 bp, Homo sapiens
ttagtgcccgctacttgagtttttaagaatatgtgcttgtcccaggactctaccctcttttgtgtaaaataatttttatgatctgggaagaccactcatctttttatttctgagccaaagcagataccaatgatgatattgacaactactgtcattaacatttctgtagttcttagtgtatgctaagttcattggttctgagtgatttcgtaatggcaactcgtttaattgtcacagtaactcaataaaatttttgtagataaactgagtctcagagagattagtgacttgcctaaggtcacagttggtacgtggcagagtcaggttttggggcccttctagagaaattatcggaatcctttgctctcccaaagggttttcctttccacttctccatcacctagaggttttccctgaagactgcttctcccccaacctgtccatgggaggtgtttagagctaaaaatagcaatgttagccaggtattgctcttctcattttaatgggtcacggcttatcttttgttccttttagtatttgcataagcttttcaagagagaccaccataaggggcagcgttaccatgaaaaacagatcagtctttatgctgaatatgatcgaccaaacttacttccctttctccgagacagtacccattgcccacttgaaaaggtaaggcacagactccccgacttgtacactttggatgaagaggttgtcattgatggtaagttgtttgtctttcttctctttctatctctgttcatctgtccctttccagggggaagactgttgctctcaaagaagtaggtttttggctgggacattctg

SEQ ID NO: 430703 - DNA, 6048 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattggccaggcatggtggtgcatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtgggtgggagtgcaggcacgcaccaccatgcccagctaattttttgtactttggtagagatggggtttcaccatgttgcccaagctggtctcgaactcctgagctcaggaatccgcccacctcggccttccgaagtgttgggattacgggcgtaagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtctatttatgtcaccagtaaggcttccagtccacagtagtctattagtagttaggttttgggggaattatacgtggatttttgactgcatggggtgtcagcacctcatcccccacattgttcaaggttctactgtattttaatattaaaaaccaaacatgcattgagtaatta

SEQ ID NO: 430704 - DNA, 4857 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattggccaggcatggtggtgcatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttcctta

SEQ ID NO: 430705 - DNA, 4864 bp, Homo sapiens
ctctggggaaaatgtctacttattctgtctctgtttgttttttgtttttttaatatatactttctttctgcctgggatgtttttactgccagcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattggccaggcatggtggtgcatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtgggtgggagtgcaggcacgcaccaccatgcccagctaattttttgtactttggtagagatggggtttcaccatgttgcccaagctggtctcgaactcctgagctcaggaatccgcccacctcggccttccgaagtgttgggattacgggcgtaagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtctatttatgtcaccagtaaggcttccagtccacagtagtctattagtagttaggttttgggggaattatacgtggatttttgactgcatggggtgtcagcacctcatcccccacattgttcaaggttctactgtattttaatattaaaaaccaaacatgcattgagtaatta

SEQ ID NO: 430706 - DNA, 4765 bp, Homo sapiens
ttagtgcccgctacttgagtttttaagaatatgtgcttgtcccaggactctaccctcttttgtgtaaaataatttttatgatctgggaagaccactcatctttttatttctgagccaaagcagataccaatgatgatattgacaactactgtcattaacatttctgtagttcttagtgtatgctaagttcattggttctgagtgatttcgtaatggcaactcgtttaattgtcacagtaactcaataaaatttttgtagataaactgagtctcagagagattagtgacttgcctaaggtcacagttggtacgtggcagagtcaggttttggggcccttctagagaaattatcggaatcctttgctctcccaaagggttttcctttccacttctccatcacctagaggttttccctgaagactgcttctcccccaacctgtccatgggaggtgtttagagctaaaaatagcaatgttagccaggtattgctcttctcattttaatgggtcacggcttatcttttgttccttttagtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattggccaggcatggtggtgcatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtgggtgggagtgcaggcacgcaccaccatgcccagctaattttttgtactttggtagagatggggtttcaccatgttgcccaagctggtctcgaactcctgagctcaggaatccgcccacctcggccttccgaagtgttgggattacgggcgtaagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtctatttatgtcaccagtaaggcttccagtccacagtagtctattagtagttaggttttgggggaattatacgtggatttttgactgcatggggtgtcagcacctcatcccccacattgttcaaggttctactgtattttaatattaaaaaccaaacatgcattgagtaatta

SEQ ID NO: 430707 - DNA, 4647 bp, Homo sapiens
atttcaatttaatttaattttaatcaatttaaacttaaatagacacatagagcaagtggctgctgtcttggataactcagatgaggcttcaaactgcaaactcttttgtggtttgagactagcatgttcttaagcattctcatgtgcagaagaaaatgggtaatggttctgtctgaaatcttgaatggtattttaaagtgtgtaagtgaatttccaagtacagaattgattcatggataccttttaataataaattattttaagcaacataaatgcttatcattagtcagactatctttctctaaacattctccttattcagttgtattacagtgttctatttatctgtgaatggcagtcccactcaactataaactatctgtatcttaacacccagaacaaatctagggagatgtgttctttatttgtttgctttgttttatttttaaagaagctgtggaaaaattctttcaagtgtaagtttaaatgactttattactgtttgttcttatttggtcgcctatagtaacatttttaccctgctttaattgaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattggccaggcatggtggtgcatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtgggtgggagtgcaggcacgcaccaccatgcccagctaattttttgtactttggtagagatggggtttcaccatgttgcccaagctggtctcgaactcctgagctcaggaatccgcccacctcggccttccgaagtgttgggattacgggcgtaagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtctatttatgtcaccagtaaggcttccagtccacagtagtctattagtagttaggttttgggggaattatacgtggatttttgactgcatggggtgtcagcacctcatcccccacattgttcaaggttctactgtattttaatattaaaaaccaaacatgcattgagtaatta

SEQ ID NO: 430708 - DNA, 4478 bp, Homo sapiens
cttaatggagggaaacagagcttaaacaaatgactacagatttggaaggaagcagtgctgtaaggaaacctgaagtagtgtaaagagagaaagcttagtgggaaaggccctttcttttcatttggtgtcttgttttctactcttgctcatgaaatgttctgagtagcttcaaatatgttttaaattgaattgtgtagagtccagtacctctgagaggtaactgagtgcagctattctagggagatgtgttctttatttgtttgctttgttttatttttaaagaagctgtggaaaaattctttcaagtgtaagtttaaatgactttattactgtttgttcttatttggtcgcctatagtaacatttttaccctgctttaattgaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattggccaggcatggtggtgcatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtgggtgggagtgcaggcacgcaccaccatgcccagctaattttttgtactttggtagagatggggtttcaccatgttgcccaagctggtctcgaactcctgagctcaggaatccgcccacctcggccttccgaagtgttgggattacgggcgtaagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtctatttatgtcaccagtaaggcttccagtccacagtagtctattagtagttaggttttgggggaattatacgtggatttttgactgcatggggtgtcagcacctcatcccccacattgttcaaggttctactgtattttaatattaaaaaccaaacatgcattgagtaatta

SEQ ID NO: 430709 - DNA, 3813 bp, Homo sapiens
tcgcatagcaacatgattataatacctgttttgtgtctgatcataccacccctcaggaatgcttttgtaaataagccattctctaaaggcaccttattgctgaaaattaaactgcaactcgactttcagtcgggattggtttaaaatgatcttgcttgttgcattaagttctcctcctttctctgccctcctcgccagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattggccaggcatggtggtgcatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtgggtgggagtgcaggcacgcaccaccatgcccagctaattttttgtactttggtagagatggggtttcaccatgttgcccaagctggtctcgaactcctgagctcaggaatccgcccacctcggccttccgaagtgttgggattacgggcgtaagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtctatttatgtcaccagtaaggcttccagtccacagtagtctattagtagttaggttttgggggaattatacgtggatttttgactgcatggggtgtcagcacctcatcccccacattgttcaaggttctactgtattttaatattaaaaaccaaacatgcattgagtaatta

SEQ ID NO: 430710 - DNA, 3301 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttcaaaaaaagtcgacgcggccgc

SEQ ID NO: 430711 - DNA, 3374 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagaataacccagtggagagaagtgttgtggcttccatcctgctcagtggaatgctggtgctgccattgcttagagctgaggttctcaagctctaggatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttc

SEQ ID NO: 430712 - DNA, 2956 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtctatttatgtcaccagtaaggcttccagtccacagtagtctattagtagttaggttttgggggaattatacgtggatttttgactgcatggggtgtcagcacctcatcccccacattgttcaaggttctactgtattttaatattaaaaaccaaacatgcattgagtaatta

SEQ ID NO: 430713 - DNA, 2678 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctgaaaacaatggaactggaaaatcttgtcttttagaaaagaaattaatcccaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcccttggtttta

SEQ ID NO: 430714 - DNA, 2358 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaacaattactatttttcaggatgctggtaacttctatagaacttgaattaaaacatttccttaaaaattcgg

SEQ ID NO: 430715 - DNA, 1837 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtgagtatacttaagtgtctctttttccatatcagtctgtgttgaaaagtttttcatactttagatttggcaaactccaagtggagaagatgtattttataccattttcctacattccttcttagtaaaaacctctcataaacctcaaatgagtaggcgataaggacatgtgtgaaactgtacaattgcaatgtaatctgtttcccgagaagagaacccctaacgcacgcgcttgggagaggcagtggttaggaaaca

SEQ ID NO: 430716 - DNA, 1278 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggattcagaagtgagacggggatcctctatataag

SEQ ID NO: 430717 - DNA, 1132 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatca

SEQ ID NO: 430718 - DNA, 786 bp, Homo sapiens
ttgctgtcaggtgactctcccgtggcgccatggcggaagcagtggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaaggtaagtgctgtgtgtctcctaccttgatatgtagccttgaaggggtgttgtgtgtttactctgtaatttatccttaatgtttttatgtctggctattcattaggagaaattcgagaaagacaaatgtaatgaaatctgatgatcatcatctcttgggggagttgtggcttcagtgtttctcactacattgctttttttgttgagacggagtctcgctctgtcgcccaggatggagtgcagtggcgtgatcttggctcactgcagcctccgcctcctgggttcaagtggttctcctgcatcagcctca

SEQ ID NO: 430719 - DNA, 426 bp, Homo sapiens
ctgtgcattggccatgactcctaaaccagagttgggttctgtttctcttgtagattattgctgtgcacccacatttcgtgagatccagttgcaagcagtttgtgaccggagggaagaaggtaagtgctgtgtgtctcctaccttgatatgtagccttgaaggggtgttgtgtgtttactctgtaatttatccttaatgtttttatgtctggctattcattaggagaaattcgagaaagacaaatgtaatgaaatctgatgatcatcatctcttgggggagttgtggcttcagtgtttctcactacattgctttttttgttgagacggagtctcgctctgtcgcccaggatggagtgcagtggcgtgatcttggctcactgcagcctccgcctcctgggttcaagtggttctcctgcatcagcctca

SEQ ID NO: 430720 - DNA, 504 bp, Homo sapiens
tcctctaaagtatagttgtagattctcttccaaaaagggcagatgcgtggtagtaggaacatgaggactctttccccttgcaaatgattattcttttatcatctcttctgaccattttctttttctatgctttataggaaactgggtcccttgaagaatctacagatgagtctgaggtaaggtggtgactcaggagccctcggatttgtagctcaccacgttgttctcttgagttgcgcttctttgctaaatgcaacattcccaggggctgagggtgtaaagcagggcgataggtaactaagccttggggaagagcttttaatatgccagctatcttaaaaaagattaaatggattagcttaaaaaataagaaaaggaacaaaaagttttcatctgaaacaatattttaacttgaaacatgttggcagttggaaaattgatacaaagttttagaaatttatctcaacactttaacatccccctcacctgctttttaaaaatagc

SEQ ID NO: 430721 - DNA, 1228 bp, Homo sapiens
ggatgacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagttcaaaaatgaatttataattcaattttt

SEQ ID NO: 430722 - DNA, 1200 bp, Homo sapiens
ggacgcgtgggtcgacccacgcgtcgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagttcaaaaatgaatttataattcaattttt

SEQ ID NO: 430723 - DNA, 1200 bp, Homo sapiens
ggatgacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagt

SEQ ID NO: 430724 - DNA, 1294 bp, Homo sapiens
ggacgcgtgggtcgacccacgcgtcgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctggtagacccaggagttaaatcagaatgtctcgcaagacttccagcatcatttgctcctataagcttacaaaatgagatctctcttcccagaactgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagttcaaaaatgaatttataattcaattttt

SEQ ID NO: 430725 - DNA, 1138 bp, Homo sapiens
ggatgacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacggtgggtttctcgctgggtgcgacgtgaatttgtgaagctcaggatgcccatggattagactcatgtagtagcttaaagagtcattaggcgataggagggagaaaaccaagaagttagcagagtctggatataattcagtgtccgtaaatcccatgaagagaagctcatcagaataaaggcaatgaatttgtgccagaagagcctgtgactacatttctttcaatctctttggctgtttgtttcagtatacacactccctgttattgcttactattttatgagctctaataaatgtacttctcaagttgctcatgaattgctgagttttaaccattgtaaattcacattctccatctttttagtttatgtcagcttgctctcttttcaaggcttagaattttcattaaaaaggcaggatctgattagtcagagaaagccatgaattattcctattaaacattctggtgaaagaattgttagactttaaaaacattgtgttatctttcttcatgtcattaaaaggcataaatatcaaaatattcactataattactgtcatatatttattttgttcaacattgacctttatatattatagacaaaatgtaattttaaagatttaggcatgatttattacctagattctctccattggaacacttttctatgacatgggacttat

SEQ ID NO: 430726 - DNA, 651 bp, Homo sapiens
ggatgacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacggtgggtttctcgctgggtgcgacgtgaatttgtgaagctcaggatgcccatggattagactcatgtagtagcttaaagagtcattaggcgataggagggagaaaaccaagaagttagcagagtctggatataattcagtgtccgtaaatcccatgaagagaagctcatcagaataaaggcaatgaatttgtgcca

SEQ ID NO: 430727 - DNA, 281 bp, Homo sapiens
ggacgcgtgggtcgacccacgcgtcgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcgtagagatgaggtttcaccatgttggtcagcctggtctccaattcctgacctcgtgatccgcccaccttggcc

SEQ ID NO: 430728 - DNA, 1206 bp, Homo sapiens
gatatgcactctaagggttgtttataaagaaacatgcacagccatatatagaaatggttatgttttatgaacaatataactagtttaatgcatagttataccttattttaactgcctgtgagccacaatttcaggtactttttaatatatatttttgtattaaaattacctcaggagcttagcttttttcttctcttttaaaattatgcagacattaaataagaagttgagtaaacagattcaggactctagaattaaagccagagctagaaattcttaacttataatttttaaggcattgagttagaagttacatatgagacaaggatttgtgggcatgggatgaagggccttacaggatggagagaccatacaggctatggagtgagtctagaaagcatagaacgtgtttagagaacagaaaatacctaattttataagctctataaggtgtatgaatggtagtacaaatggagaaagggtattagagcatttactcattttattcatagtcaacgggtaccctcttcagtggatattggaatttatgttttacagacaaggaaacttagttatgtgttttgcccaggctaataagttatggaagcacaattcaaaataggtctgtagctttggctttgaatacctgggtagtgagtaaaattttcatttcatgtggtggtttttacatagttgtaatccaagcagtaacacttacaggaagattagattgtcagtaatgtgaacagtagattggaggggaagaagcaaagagagccagtcttaattggttggatacttttatttctgtattcctcagtgatgttataaataaatattttgtttttcagagaatgactaatagtagcagctccccaagccttctaaatgacagtgccaagccatattcagcccatggtaagacctgatcccttttgcttatgtgtgtctgtgtatatatttcttactctaaaagtaatatacaaccattgtagaaattttgaaaattgtaaacgggcataaagaagaaaataaaaattattatcttcccactcagatctaactattgagatttagattccaggccaggtgtggtggctcatgcctgtaatcccagcactttgggaggctcaggtgggaggaatgattgagcccaggagtttgaaaccaacttgggcaatataacaagaccatgtctctattatt

SEQ ID NO: 430729 - DNA, 1220 bp, Homo sapiens
gatatgcactctaagggttgtttataaagaaacatgcacagccatatatagaaatggttatgttttatgaacaatataactagtttaatgcatagttataccttattttaactgcctgtgagccacaatttcaggtactttttaatatatatttttgtattaaaattacctcaggagcttagcttttttcttctcttttaaaattatgcagacattaaataagaagttgagtaaacagattcaggactctagaattaaagccagagctagaaattcttaacttataatttttaaggcattgagttagaagttacatatgagacaaggatttgtgggcatgggatgaagggccttacaggatggagagaccatacaggctatggagtgagtctagaaagcatagaacgtgtttagagaacagaaaatacctaattttataagctctataaggtgtatgaatggtagtacaaatggagaaagggtattagagcatttactcattttattcatagtcaacgggtaccctcttcagtggatattggaatttatgttttacagacaaggaaacttagttatgtgttttgcccaggctaataagttatggaagcacaattcaaaataggtctgtagctttggctttgaatacctgggtagtgagtaaaattttcatttcatgtggtggtttttacatagttgtaatccaagcagtaacacttacaggaagattagattgtcagtaatgtgaacagtagattggaggggaagaagcaaagagagccagtcttaattggttggatacttttatttctgtattcctcagtgatgttataaataaatattttgtttttcagagaatgactaatagtagcagctccccaagccttctaaatgacagtgccaagccatattcagcccatgatcctctaacatcacctgcttcatccttgtttaatgactttggtgccctcaacatctctcagagacgaaagagacggagcttgtctttgtcacccaggctggagtgcagtggcgtgatctcggctcagtgcaacctctgcctcccaggttcaagcaattctgcctcggcctcccaagtagctgggactgcagatgcacactgctgacacacggctaaatttcttttgtgttttagtagagatggtgtttcaccttgttggctcagtctggtcttgaactcctgagctcaggcaatctgccca

SEQ ID NO: 430730 - DNA, 1095 bp, Homo sapiens
tcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaa

SEQ ID NO: 430731 - DNA, 1001 bp, Homo sapiens
  misc_feature (30)..(30): n is a, c, g, or t
  misc_feature (40)..(40): n is a, c, g, or t
actaaggacctcatgttggtcaacagaaanaccccagggngtatttaaaactgagcagtactatacgtctagtgcgagctggtgcggattgagccggtggcagcgggggcgccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaa

SEQ ID NO: 430732 - DNA, 1225 bp, Homo sapiens
tcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaaaaaataaaaaaaaaactggggggttttttggggggggggaacaagggtaaaaggggactgggaatttttccggaccctttttgtggcaaggggaaagcgggcccaagggggaaaaaagaaccggtattga

SEQ ID NO: 430733 - DNA, 1517 bp, Homo sapiens
tcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaacaaaaaattgcggccgtctggccaactgtctttaatttgacaagcttatcatgtgggccaatttggtctcacttgggaatctgcctctatatgggcgcatacaaaaaaatgtccggcgttttacaagtgtacattggaaaaactcggggtcccacacttaacgcttttagaaatatcctttcacctgtgttatatataaagaccccacataggcttcttaaattgtaccccttaggctagggattgtgagtaaatatttaaaactcctaaattttgataccctcttttacacaggcgatatgaaacctttttaacatcctccttatttggtgttcaccacaatttcctatggactgctctcctattgtctcatctttaggggtcctctgtctctccacacataccttttcttctctctcccg

SEQ ID NO: 430734 - DNA, 1219 bp, Homo sapiens
tcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaaaaaaaaaaaaacaaaaaaaacgcggccttattgggaaagaaggcgattgggggggaaattaaaaccctcttaattgtcacccttcctttgtttttctatatcttctaatctacttcctcactct

SEQ ID NO: 430735 - DNA, 1071 bp, Homo sapiens
tcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaa

SEQ ID NO: 430736 - DNA, 847 bp, Homo sapiens
gttcactgaccacctttgatgccatttctaagacctacagctacctgaccccccgacctctggaaggagactgtatgcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaa

SEQ ID NO: 430737 - DNA, 1033 bp, Homo sapiens
tcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccaattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaa

SEQ ID NO: 430738 - DNA, 1133 bp, Homo sapiens
tcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaaaaaaaaaaaaacaaaaaaaacgcggccttattgggaaagaaggcgattgggggggaaattaaaaccctcttaattgtcacccttcctttgtttttctatatcttctaatctacttcctcactct

SEQ ID NO: 430739 - DNA, 613 bp, Homo sapiens
  misc_feature (440)..(441): n is a, c, g, or t
  misc_feature (444)..(444): n is a, c, g, or t
  misc_feature (591)..(591): n is a, c, g, or t
  misc_feature (593)..(595): n is a, c, g, or t
  misc_feature (609)..(610): n is a, c, g, or t
  misc_feature (613)..(613): n is a, c, g, or t
tcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccactccctgcccnnaangatctctgattccttaatgggcagggagaagagatagatctcttaaggaatcagagatcattgatttcttcctgggggcctctctcaaggatgaggttttgaagattatgccagtgcagaagcaacaaatgccttgaacctagtctngnnngggggcccggtacnnggn

SEQ ID NO: 430740 - DNA, 2377 bp, Homo sapiens
gtgaagatgaagattacttctcaaaaagtatccatatttccagtgttccttttaataaaatatgccacttttaaataaataattacaaaatgtaaaattataaaatttttaaatttaaataataagtaacagtaaaattttttgacaatatatatgtcactgtctttgtaatttaaacatattgctgcctgggatatgggtaacagaattatcactcatggaactttgtagtagtgatggcttggtttgtaattcatcatttcatctttcttggtcttgattaatcctgaaatccttaaaatggctggcatggttatgactttattgtggtaaccttggagatataagccctcttacgatcaaaaacagaagaaaaaaatatattgttcaaactgatgccaggcctacctttattccctcccttaattactttttttctcattcagctcagatcatcctgcacttgaaaaatgaagttttaccaccatcaaaactatcattatttaacaacaagtgaagatcaacagaaaaattcaagtagctttgcaaatactagttgatactcagtgaaatcacgtcactattttgatgcctgaatccatacctttgtgatttatgtttaattacagaagcctattgccttgcagcaattttgttgttataatactgattaattggttactccttcttattataactcagtaatacctgtggtcatttggttcctctatcctgacaaagttcactggaaattgccctcagattttataaactgggggatttcttaattagataaaagttcattactgaagatggaatattatataagatggaggaagggtaattaatagacatgagatatagaaatactttgttagccctgctatagattgcctattgtagtctttctgtgcatttcaatagtctgtattaggaaattataacttcagcacttttgatagcaaaaattggcatctttcaattctgtatagtatgtgactatcctgtaaatgataatatgtgtacagactgagaaggcaggaatataaagtaattgaaatctctcattgccggtatactctaaaacatgcttgatgccttgtcagcatcattgcacacattgactctgtatttacatctgtatatacactatgattaggaaaatatgcaagaaattgtttttccatgttaaggaacaaatgccattaggaagatgtccccttaattgtattgtcagagtattactatgtcaaggatgactgttctgttaacctaattttgtgttttcacatggaaatgtgattggactccatttttctgtgagttgagagtaagagcataagtcagtttgaaagcatttacaagtttgttttagaatgtagtaagggctgaaaggtgctctacttcttaacttgttttttccatgttgtagacaaatgaaatttgtctaaatgcttttgtctaaaaatgcatttgtctaaatgctttagattgatgtagggtttagatcctctttaatactttgagatagtcttattctgattttttttttcttctggaaaccaagtagaattagggatgggaatacaaatgcatttattctggcttctgttttattccaagaagcttcttggaacaaatcagtaggaattgaaaagaaagcatgaccaacccaattacaggggataaatgtaagcttgttaaagtaagcaccacaccatgtttctgtctccccagcacccagcacagtgctgtgaaccttggcagatgctagataaatgtgtgttgaatgaatgtgcctatgaagccacaaagatgccacatgttagtatatcagtgagaggtgactccacagtgctctctggagaagcaatatgagtgactgaagagtggggccttttgcttttgcctggatataggggtgctcttctactgtaattgggtgtggaaaaactctggctttatggtattccattaggttcttttcatttaaagtagtcttaaaatcaaagtatccaatattttaaagccacaaagtagattacataattagcagagattttagtcagtaaaatgttagaaatcaaactataagaaaattcaagtcctttattttgtgtcttgggtatatgtcattattttaaattccacactcccttatttaatcactttggtaagtgcctttgatgttttgaaatgtatagtgggagatgagcaaatgtaaatgtcatgtgccctgttccctagcttctcaattcctcataaccatttttaccagtgttgcaaagtttagacctttgtgttaatatcagaagtgtatttgtagcccctccatagtgaacaatgaaataaactatttcatagaaaacaaaaatta

SEQ ID NO: 430741 - DNA, 1953 bp, Homo sapiens
tcgcaattgtattgatgtaagaaaatcgattaacactattcatatgtaacaatggataggttaggttcagagacagtacagttcataatagtagtagatacagggcaggtgagccctaaaattgaagcttagcctgggagagttcttaacttcatctaagaaggaatctgatgcagggcaggaaggctcccaaattggagcttagcccaggaaggttcctggcttcatccagaaaagaattcaagggtactactgaggtgtaagcgcttacacctcagtaatacctgtggtcatttggttcctctatcctgacaaagttcactggaaattgccctcagattttataaactgggggatttcttaattagataaaagttcattactgaagatggaatattatataagatggaggaagggtaattaatagacatgagatatagaaatactttgttagccctgctatagattgcctattgtagtctttctgtgcatttcaatagtctgtattaggaaattataacttcagcacttttgatagcaaaaattggcatctttcaattctgtatagtatgtgactatcctgtaaatgataatatgtgtacagactgagaaggcaggaatataaagtaattgaaatctctcattgccggtatactctaaaacatgcttgatgccttgtcagcatcattgcacacattgactctgtatttacatctgtatatacactatgattaggaaaatatgcaagaaattgtttttccatgttaaggaacaaatgccattaggaagatgtccccttaattgtattgtcagagtattactatgtcaaggatgactgttctgttaacctaattttgtgttttcacatggaaatgtgattggactccatttttctgtgagttgagagtaagagcataagtcagtttgaaagcatttacaagtttgttttagaatgtagtaagggctgaaaggtgctctacttcttaacttgttttttccatgttgtagacaaatgaaatttgtctaaatgcttttgtctaaaaatgcatttgtctaaatgctttagattgatgtagggtttagatcctctttaatactttgagatagtcttattctgattttttttttcttctggaaaccaagtagaattagggatgggaatacaaatgcatttattctggcttctgttttattccaagaagcttcttggaacaaatcagtaggaattgaaaagaaagcatgaccaacccaattacaggggataaatgtaagcttgttaaagtaagcaccacaccatgtttctgtctccccagcacccagcacagtgctgtgaaccttggcagatgctagataaatgtgtgttgaatgaatgtgcctatgaagccacaaagatgccacatgttagtatatcagtgagaggtgactccacagtgctctctggagaagcaatatgagtgactgaagagtggggccttttgcttttgcctggatataggggtgctcttctactgtaattgggtgtggaaaaactctggctttatggtattccattaggttcttttcatttaaagtagtcttaaaatcaaagtatccaatattttaaagccacaaagtagattacataattagcagagattttagtcagtaaaatgttagaaatcaaactataagaaaattcaagtcctttattttgtgtcttgggtatatgtcattattttaaattccacactcccttatttaatcactttggtaagtgcctttgatgttttgaaatgtatagtgggagatgagcaaatgtaaatgtcatgtgccctgttccctagcttctcaattcctcataaccatttttaccagtgttgcaaagtttagacctttgtgttaatatcagaagtgtatttgtagcccctccatagtgaacaatgaaataaactatttcatagaaaacaaaaatta

SEQ ID NO: 430742 - DNA, 1157 bp, Homo sapiens
gacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgc

SEQ ID NO: 430743 - DNA, 1178 bp, Homo sapiens
gacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgcttcggcttgtacagaaaaggg

SEQ ID NO: 430744 - DNA, 1841 bp, Homo sapiens
  misc_feature (1411)..(1411): n is a, c, g, or t
gacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgcaaaaaaaaaacaaacaaaaaaaaaaaaaaaaatgtgtgtgtgggcgccgcggcccggggccccgtggagaaagagtttttaaagaccatttcccgttgtgggcccgcgggcgggcccccagagttggtgttccgggttgaacccgtgtggcccaaggaggggtgtctcccaaggggagaaacccgggggcccagtgaccatcggtgggcccggggcttttcctccacccaaaataaaaaacgggccgcgggggnactaccggagcggggctctggaaaccaattcccagagtgggggagtcccgggagagcgaccatcgcgggcgtctcatcaaccaacagcggggctccccaggcagggacgtcggaatatcaaaattatgcccgggcgcggggacgcacagacaccgcgcaacgcagacacgcagaaacacgcagccacacatcaggtcgccacacgaagaccaggcagacgacaggaaggacagcaacgagcagaacgaacagagaagaagaggcagacggagcagcagacaggacaaccaccaggcgggaacaacgagcgaaggaggacagagcaagcgaagcaagggcggaggaaagcgccggaagcggagagagcgagaacaacgcccgggagggaccaggcaaggggaaagaagaagaaaaaaaaaaacggccgcga

SEQ ID NO: 430745 - DNA, 1383 bp, Homo sapiens
gacctcatgagtaagctgtggcggcgtgggagcacctctggggctatggaggcccctgagccgggtaagcgcgaatagatcaagcaatttaggtcgtgttagaaaagaagtcccgttcttgctcctcggagagtccaggtacttcggccacaggtggcaaggagaaaggcggtgctgttgttatggtaacagcgagtactgcgggaagggtgggatccagtaggggcttaggttattcagggcttcccctgccaccctccggccaaacactgtcgacaggctttccttccgagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgc

SEQ ID NO: 430746 - DNA, 1278 bp, Homo sapiens
gacctcatgagtaagctgtggcggcgtgggagcacctctggggctatggaggcccctgagccgggtaagcgcgaatagatcaagcaatttaggtcgtgttagaaaagaagtcccgttcttgctcctcggagagtccaggtacttcggccacaggtggcaaggagaaaggcggtgctgttgttatggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgc

SEQ ID NO: 430747 - DNA, 884 bp, Homo sapiens
gacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcccccgtcccatgcccgctcttgagtatcttccccaccctattaaattacatccggtgc

SEQ ID NO: 430748 - DNA, 750 bp, Homo sapiens
gacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgc

SEQ ID NO: 430749 - DNA, 1434 bp, Homo sapiens
  misc_feature (1004)..(1004): n is a, c, g, or t
gacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgcaaaaaaaaaacaaacaaaaaaaaaaaaaaaaatgtgtgtgtgggcgccgcggcccggggccccgtggagaaagagtttttaaagaccatttcccgttgtgggcccgcgggcgggcccccagagttggtgttccgggttgaacccgtgtggcccaaggaggggtgtctcccaaggggagaaacccgggggcccagtgaccatcggtgggcccggggcttttcctccacccaaaataaaaaacgggccgcgggggnactaccggagcggggctctggaaaccaattcccagagtgggggagtcccgggagagcgaccatcgcgggcgtctcatcaaccaacagcggggctccccaggcagggacgtcggaatatcaaaattatgcccgggcgcggggacgcacagacaccgcgcaacgcagacacgcagaaacacgcagccacacatcaggtcgccacacgaagaccaggcagacgacaggaaggacagcaacgagcagaacgaacagagaagaagaggcagacggagcagcagacaggacaaccaccaggcgggaacaacgagcgaaggaggacagagcaagcgaagcaagggcggaggaaagcgccggaagcggagagagcgagaacaacgcccgggagggaccaggcaaggggaaagaagaagaaaaaaaaaaacggccgcga

SEQ ID NO: 430750 - DNA, 933 bp, Homo sapiens
gacctcatgagtaagctgtggcggcgtgggagcacctctggggctatggaggcccctgagccgggtaagcgcgaatagatcaagcaatttaggtcgtgttagaaaagaagtcccgttcttgctcctcggagagtccaggtacttcggccacaggtggcaaggagaaaggcggtgctgttgttatggtaacagcgagtactgcgggaagggtgggatccagtaggggcttaggttattcagggcttcccctgccaccctccggccaaacactgtcgacaggctttccttccgagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttccctgggggggcccgagggtcctggatccccccttttggctacgtaaggcccttaacccggactctgcgccccgtcccatgcccgctcttgagtatcttccccaccctattaaattacatccggtgc

SEQ ID NO: 430751 - DNA, 562 bp, Homo sapiens
gacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacccccgtcccatgcccgctcttgagtatcttccccaccctattaaattacatccggtgc

SEQ ID NO: 430752 - DNA, 548 bp, Homo sapiens
tatgttattcaattgaaatattttctatcttagctgcaactaaagaattttattttcaagatacaattctaaatctgatgtcaaagtaaacatttttgtgtataggtgaaggtggtataatatctgggaattccttcaaaataatctgagggaagataagtgtgtgtatagattttttaaagattggtttataaattgataattgttaaagtaggttgataggtatatgggagtttattatactatcccacttttacgtgtgtttgaaaaaattttttttaaatcgttgtttttttcccccttttgccttctaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430753 - DNA, 929 bp, Homo sapiens
cagtatagtgaagagttcaggccctggagtcatacatggattcaaatctctgccctgctccatactacctgatctgggcacttgccagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430754 - DNA, 783 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtaagtatgctaagaggtctcccaaataattgatgaattgaaactttttacagaacatgtatacagaattatttaaataacacttgagttctgaacatgtggtttggaaaatacatagagtgggaaaatctttataataaatcagaactaaaggataggtttcacaacagtatgtcgggcattatctttaagctttagatgctgttagac

SEQ ID NO: 430755 - DNA, 211 bp, Homo sapiens
ggatccaggtctgtgattctcaagcctgctcttgcagggcactgatattcaggatgcaggagaagagtactttgcaattaaatcagagtaaaagcagatgcggccgcgaggtccctggattgaaaaaggagcctctcccactcctcctaccaccgaagtggttaggactctatataaataaaaacaaggcttttggaaaataattgcatcc

SEQ ID NO: 430756 - DNA, 1080 bp, Homo sapiens
  misc_feature (63)..(63): n is a, c, g, or t
  misc_feature (68)..(68): n is a, c, g, or t
aagcatgctatcaacgcagagtgcccattatggccgggaagcagtggtatcaacgcagagtgnattanggccggggtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430757 - DNA, 1066 bp, Homo sapiens
ggaacgtggcatcgactgggacactagacatgatatgctggatggatactcctgttgtccgaccgtggtaaattccggcgatgtgcctattgtgctggtctgcttgatctcggtagcccaggtatagcgtcataagtagatgtaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430758 - DNA, 1526 bp, Homo sapiens
tacgggccgggatctgggatcgcccatctcggcctcccaaagtgctgggattataggcgtgagccactgagcctggccttagattttcttaatagcaagagtacaattatttctctttctttaacatgttttccccagtatttctcacctaaattcttttttgtgtaagcaaatctaataagaaaattggttttgcaagttagactagtcaacgtttattaggtgcatattcttttttattcaaggaataataataaacattataatagcaaactgacataacttgataaagaacttgatggaaccatgtctcatctcagccaggtgtggtggggtatgccttagtccgcactgcttgggaggccaaggtgggaggatcgcttgggcttgaacccgggaggcggaggttgcagtgagctgagattgcaccactgtactccagcctgatgacagagcgagattccatctcaaaaataaataaataaataaggtttcttgtgctttctatgactgcatcagaacagagaatgtcagtatccaataggatgccagtggaattccctgacgattccatccatgcggctctgctggagcagggtagtgtcctaggctgggagaatgggatggagcctccacctcatgaagtagcttcctttggaggtggctatggcaggtcttcggagagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430759 - DNA, 1123 bp, Homo sapiens
  misc_feature (1005)..(1005): n is a, c, g, or t
  misc_feature (1008)..(1008): n is a, c, g, or t
  misc_feature (1011)..(1011): n is a, c, g, or t
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatgtgatggaaagggcttccatctctacacnganggntgggtttttataaaaagggttggagcacaaaaaaaagaaacaaaaaaagggggaatactcgggggagagaacatttagaggaagaataaaaagggcaaaggagagattactt

SEQ ID NO: 430760 - DNA, 928 bp, Homo sapiens
  misc_feature (34)..(34): n is a, c, g, or t
atcacggctaggtagatgctgtggtgtaatcggncgaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtaggacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430761 - DNA, 1117 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattctttcccagttcctgcttcttgaaaccagttcctccagttcctgcttcttcctcttcatagtcatcttctgaaggattaaaagtctcatcttcaatttcagactctgaatccccttcttcagcatcactcccctcaacctcaggctccaggaaaagacaggcaacttgttcgaagaagccctcagggtcatcaacaatggtcttcatgattttagtccagttgagggactgtactccttctgtgtatttcaagaaagaggaactgg

SEQ ID NO: 430762 - DNA, 988 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattctttcaagaagcaggaactggaagcaggaactggcaagaagcaggaactggagtttctaaactcttattctcaatgtctgtactacaggcagtgcatttgactgcagactaataaactagtcctggactgtacattt

SEQ ID NO: 430763 - DNA, 830 bp, Homo sapiens
attatacagtttatttttatggttccatagtattgttttctccaagaagcagggcaaattaaaaacataattttttttataactacacagaaacctgtatgttttttaaaaaattatctttgtttattttgtttattaggacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430764 - DNA, 1258 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaagtaagtcaaccaaaaggagctgactttttttatgctatatagaacagtgaggatctttgtataatttctatacaaagctattcctgaattacatcccaggattcaagttgtcaacttaataatgaaattgatatcatacagctgacataggaaaatttgagttgcttttattcacttaattccttatttcgtaatgtatttgaggtggctttcaacaaaacgcatataataggaaaatataaataaaaataggaaccagctgggcatggtggcacacacctgtagtcccagctacttgagaggctgaagctggaggactgcttgagtctaggtgttcgaggccagtcctatttactgccaagaaattaaaaacaaaaattttagtagattttgggtgtaagtctggaattaaagccattctgaagatgctaacaacatgcttctgataagtgaccaaaaaaaaattaccatctaatgcttttacgtttggtttggaagtatgctta

SEQ ID NO: 430765 - DNA, 757 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttggtggagatttgatggccattggaacagcgggggctgcattactgcctggctctgg

SEQ ID NO: 430766 - DNA, 381 bp, Homo sapiens
ataacgtcagattgtcaacgcgcaatccacgtccaccctcaaacaaccagtcactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430767 - DNA, 856 bp, Homo sapiens
ggggcttggcttccgccttgtgctggggagggcctttccggcgtggtggatctggtatggcgcccagaaagataggggaccggctcaagaaatatgaagctgcctatggaaaacagttcaccccatgccagctgctagctgaccatgctaccagccctaacaagaagttctaccagtgagcaggcctcatgcctcgctcagtcagtgcactaaccccaggggcgggcagggctggttctccaacagagttggtgaaatgaggcctctgggtggtggtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattctttcaagaagcaggaactggccagttcctgcttcttgaaacctcaggtcaccatttgtgtatgcccctttatgggatttcatgtctggaattcctgctaccactccaatgctcttcacctccatcacacacacacccacacgcacacacacaattttgggtcgctccattctactttttggttgtaagactttgtatcagatagttattaaatgattgacaatggacaaagatgtcataaatgatagtttcactaagttgccattccagacctccctagatttgcagcaccctgtgactgtt

SEQ ID NO: 430768 - DNA, 531 bp, Homo sapiens
  misc_feature (34)..(34): n is a, c, g, or t
atcacggctaggtagatgctgtggtgtaatcggncgaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgtaagtaatactgcccaaatagttaataattgcagaatataagaatttttcagccaagtgcagtggctcacacctgtaatcccagcactttgggaggctgaggtgggcagatcaccttagatcgggagttctagaccagcgtgaccaacatggagaaaccctgtctctattaaaaatacaaaattagtcaggcgtggtggcacatgcctgtaattccagctactcgggaggctgaggcaggagaatcacttgaa

SEQ ID NO: 430769 - DNA, 679 bp, Homo sapiens
atcatctagaaaaggtaaatagagcccctcgaaactaaaattgattttaactataaaatgatcagaagacatttattatacagtttatttttatggttccatagtattgttttctccaagaagcagggcaaattaaaaacataattttttttataactacacagaaacctgtatgttttttaaaaaattatctttgtttattttgtttattaggacaaattattggattccagcacagtgactcacttattcaagataactgaaaacattggttgtgtgatgaccggaatgacaggtaattaatctgtagatatacaagacatctgtagatatacaagccttttgttattttcttcaaattattttgagttttgtattaattttaaacttattgcctgattttcaagtgccatgagtggatttgcagtcttctaagactagtatcaatattttaagagtattgtgagcttttttgaaattatacctataatagaattagatgcttatgctgctgtcggagaaactgggctgagggccctttcatagatgattttatcttatttcagctatagttagtagtttaaggggacctaactcagtatatctcaaacctggtaataatggcatcggttagaagtgagtgagaattattatgaaaattattttaggttgggcacag

SEQ ID NO: 430770 - DNA, 782 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgtctaaaggccctttatcggttgtatactaatttggccactcagttcctttgaatctacgttcgcacttttgcttgccattgatatcgcatttgtttccccaattccaccgtctggctttgtctttctggcttct

SEQ ID NO: 430771 - DNA, 1081 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430772 - DNA, 1023 bp, Homo sapiens
  misc_feature (34)..(34): n is a, c, g, or t
atcacggctaggtagatgctgtggtgtaatcggncgaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430773 - DNA, 1086 bp, Homo sapiens
gtttagtctggggccgaagctgggctggagctgggaagggagaacggctgaagctggattgagctctgtggtgtttgcacccccgtctggacgcagggatcgggggcctgaaggcctgtctctgcagggcgagcggccacactgcgtagacccaatggagagttaaggaagatagggctgtaatgcctgactccggcttcgtgaggccccttcagttattgtattctgtcctggccaggcacaagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430774 - DNA, 1144 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaacaaaccag

SEQ ID NO: 430775 - DNA, 1154 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattctttcaagaagcaggaactggccagttcctgcttcttgaaacctcaggtcaccatttgtgtatgcccctttatgggatttcatgtctggaattcctgctaccactccaatgctcttcacctccatcacacacacacccacacgcacacacacaattttgggtcgctccattctactttttggttgtaagactttgtatcagatagttattaaatgattgacaatggacaaagatgtcataaatgatagtttcactaagttgccattccagacctccctagatttgcagcaccctgtgactgtt

SEQ ID NO: 430776 - DNA, 630 bp, Homo sapiens
agacggtagaaggggcaaggaacaccaattgtgtttgttagcacatttgtaataactgcaagttgggaacagttttaatctcctctgttgttattcaataatgacagtttgaatttcatgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430777 - DNA, 1031 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430778 - DNA, 943 bp, Homo sapiens
cagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcagactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcc

SEQ ID NO: 430779 - DNA, 156 bp, Homo sapiens
caactgagaaaaaactgtcattaaattagagtgcgtcctgatttaagagatacaaaaatatttcttagaatcattcaaaggtggttgagagagtggtgaaaaagggcttttctgagcataggttgtgagtatattaacactaaaagtaaacgagat

SEQ ID NO: 430780 - DNA, 2182 bp, Homo sapiens
ataaaggttttaaatagtctataccgtatactaaaactaaattaatatttaggactgaaataacatattgattaagtaccagctatgtacccaaaaaatgctgggcacagaagttagagtaagatgttttacttaaagggcctttgagtgagagttggcaattcattctgaactaaccactaatatcattaagaattagtgctgagttggtagcaggaaataggtaattctgtctaaaggaatcatgaaatggaaaataaataagcttttaataaggagaaggaagagctgaagaaatggcacagtgttcttagaatgacagatagtcctatggggactgcagcataaaagtgaaaaatgtataagataaacctttagatggtaagcaaggcaagattctcaaattctgtatgaatcagctccacctccgccccatggacagtagatgaccgttaatggcttttaaggaaagatgcaacctggaaaaaaagaaaaaaaacttgttttagaatggtaaccactggcaatatgaagaataattagactaaagaagagaggtaggataatcatgggcattggcagtggaattgaaagagtaatttcagaagcagaatggtcagatgttggaggtgattggttatagagtttaagaattgtactgattttctattgtgtaacaaactaccccaaaacttaatggcttaaagcaactattatttctcctgattctgtggttgactggatggtcgtctgctgctcttgcttagacttaggcatctgcatttagctgagggttcagccagggctggacatcctttaatggcctcattcccatgtctggggcctcaggtcagatagctgggactaccgggtctcactccagaagaggcttcttcagagcatggtagtcttggggttctaagagaatgagagtagaagctgcaaaacctcttgaaactggggcttgggagtcacacatgactttctccacattctgttcgtcaaaagcgaatcataaggacagcacagactcaagggataagaaaggagattccatctcttgatgagaagagctgcaaaggccatatttaatcagtcacaggagtctaatgctacaaagtagttttttaaaaagatgactagattggcaagttcaaggttaatctttttatttgttttatttatatatcacttagctggtattcagtaaaagcttgctttgtaaaatttagttaatatctttttggttcagcacagacattgcatcatcttagcagctctttttcaaacagatttgaagctgcttcaaataacaatctggtttataaaatgaaaatagaaaattatgatcttagaatgaagaagtgaatttctaagccatgataattattacggttgctgtgattagacagacttttctgtggagcttcctgacaaccaagaaaaaaggggaaatcaaggaactgttcttatcagaaagtaggaacccagcaattctttcattttctcattgggaacttaatagtcactgaattacaaagtagacagtgaccttgattatacaacatatgcggaagtgtttcctgtaacttacgtgagtattttatcaaatacttatatatttgataaaagctaagtacataaagcataactcagtagatagaattctctagtagtaagctaaagtgcttcaagtattagttgtcatattaatccaagagaaaattagatctgagactacctcgaggagtaaacgaacaacttctttaaaccaatactagtcaaaatgcagtccacggaccaatgctggttcatgccctatttgatccaagtccacattaagtacagaaatgaagagtaagcatttagaaacttggggcaatttgacattgcctcaacatccaagtttcagtgtcctttataaactattgatccatgacagatcatgaaactttctaaaaattgatccttttatcacatagtctttcaaaatattatttgcttctttgaagctttggatagaaacttgataatgtgaagttccatactattaactagacacagaactgcgcagcaagatgcctgctgtgtgcattccagatatagtacatagctcagctctcaaatcagcaacaaagaagataagcacaccaggtccacatagcagagaacttcgtcgacc

SEQ ID NO: 430781 - DNA, 4569 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430782 - DNA, 5145 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattaaaaaaaaaaaaaaaaaaaaaaaaaaaaaaaaaaaaaaaaaaaaaaaaaaaaaaaaaaacaaaaaaaaaaaaaaaaaaaaaaaaacaaaaaaaaaaaaaaaaaaggaggagggggggggcaggcgaactaaatcatcccccgacaggaggacaacaccaagtccagccgccgccgcagccacgtttctgtgatgagaagggggcggcctgctcacaggggggctggagatgtagttacaaaaatgagaggaggacgagggggtgctattgatcaaaaaacaaaagacagacactacggggagagcaaaaaagtagtcattctttgagatataccaatttttggtaggaaacaataaccatccttatccttgggaacgagtggtgtacactgataacacactgggggaaacgaaaaaaatcatagccaataaaaggataatctgatgcccatgccgaggacataataaaaaacatattgctcgatgttgaactgtgggaaaaaaaacagagtactattttatgtcggcgcgtaaaaagtatgtagtccgaggtgatgattttactacaaacatttccc

SEQ ID NO: 430783 - DNA, 4410 bp, Homo sapiens
ggccccagcggactcccgggcgccggtgctcggggctcggggctcggggcttgggcgtcgccggcgagcgcatgcccttccctgaagcgcggcctcttggcctggagctgggaccagttaggtaacggccccggggacccgcagtggagagtgagcggggctttccccgccgggccagcccggcgcgctcgcccctgcctgggcaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430784 - DNA, 2824 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgta

SEQ ID NO: 430785 - DNA, 4214 bp, Homo sapiens
  misc_feature (46)..(46): n is a, c, g, or t
  misc_feature (50)..(50): n is a, c, g, or t
gactcgtagatatctccagttcaaactgcagactacacaacgcgangttnagttcctagctttgaaatgtctgtgacattgaagacacccctgggcgaaataagaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430786 - DNA, 4991 bp, Homo sapiens
atagtgttgactgaggttgtctttattagaagtctcagccatgcctccagtttcgagatgaatctcaattcacaagttccactatgaatctcaattcacaagttccactaccaccaccaccatcactgcccccagatagaatgagacttctaataacttgaaagacaagtctataaatatcctgtaatcgttttcactgtatcactttttcctggctacttttatccgataaaaacctcaatttatttttaagctattaaacatgcggacaaagggaatcttagttttatgcaaaaacgcaaccacgcatgagaactgcgcaagtctttcttggaatggtctgtatttgggtgaagtcatcagacgtcattacacttctttattttggggttgccaactcgtttcccaggatttaaagactataacgatgataaaagtcagtgtcgcaccctgtcaaaggcttggcccgttgccttttccttcccggcaatactcggttcaattaggtcttgtcccctcattatctgtgaggactgaattccacccccgcttttcaacgcaggctctttgctcgggaaaagtcaaaccatctctcaaaggatcaaagagctcagccatagacagagccgccggaggaaagcggagtcgctgcatcagatgaaaggggcccctcagcctcactcctcaccgcagctcctgggatcttaaagacagggtcaggaggatcaggagggacaagagggatggaggcgaaaggctggatccttaatccaggccggagacaaagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430787 - DNA, 4524 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtgactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430788 - DNA, 5482 bp, Homo sapiens
tttttttttttaagcttttgagtgtttcacacaaggtatgttacagaagacaagtgcctaagtcagaactatgagaaatattgccatctgacaggttagattaaagaaggagagcacagcatctgggaagactgaaaagggaaccatagaaataggggaaaaatggtgaaacatgggagatgtcattgaagtcaagagaaagaaagcatcaggaaaattcaggtgtcatggagaaagcaagtaagatggggacagtgaagtttgctagacatgatacaagtagatcgttaggtgacttactgatacaacgttataagtagtgaccccttaactgtaggagttaattcatacgttgtaaagttctccagtattggtattcattgatcttaattctctcctttttaaagagaaaagttgcagacctgaatatgaagaggagcttctcttcagtcatatcttaattttccatttagcctacagatgcatgaagtagagaattgacatcatagctactggcagcctctgtagctgttaagaagagtgttcactaatgagttttatataaacaggttctctctcaattttggattcgggtagtagtctttacaatcttgaaatgtgcatgctgcactaccccaggtataccattgacagtatggggaaaggttctaagtctagtcctttaaaaaaaaaaacacacacacacattgtataaagtgattatttcagacataaagtctgactcttcaaacagttatgagttaaacttatacctacttggggctttataataaatgaatgtgctatctttttattatttactgaggagaacagattagaggcggactagaaaattagggagaatgaccaattgcttggcataattaaatggtaattttcaaaattaagttgtttgagatcttttaaaattatttacattatatattaacaaatatttacacaggttgagcatcccaaatccaaaatgctccaaaatctgaaactttttgctcaaaggaaatgctcattggagcatttcagatttcagaactggatttcagatttcagaactggggatgcttaactgataagtataatgcacatattccaaaatctgaaaaaatttgaaattcagaatacttctggtcccaagcatttcaaataagcgatacccaatctataattacatattgaatacaaatctatcccgtaagaactgatattaaggacattgcaaaaatcactataaccattcttatccaatagaaactctcatactttattttccatcttaattatgttttgcttaaactaagtatttgaattcttattccctgggcatatattaattcgtagtagataatctgcaaacaaaatacatgacttcctattactagccacttgaaaatataacaggtagttgactatatgtatgtatggtatagtataaataattgcctctaagtataagattttgaaaggtaaaaaaacaaaatgtatgtctgtactattattggtatatagtttcaaaaattcacagaagggagccaggtgctctcattgcctaacaaaataatggaaatatgtattcattctaacatcttgacatacagtataaagggcactcagcaagtgctttttagttagactgattttaaatgagtagattcaggaataccagaaaacacacacacacacagataattggttgaaaatacgaggttagaaacttaaccattgaagaggagtaaggctacttaaagcgttaaaaactaattgggtaaggtatggttgacccagctacttcatttgccttacgatgtatattcattaaactaagtcactcaccttctctgtgatgttgatggtttggtatagtaaacatgagatatgattaaaggtgattcagggatagatcaagtgtctgcctaagtaaatctgtgttttcatttttttttctagtataccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430789 - DNA, 2315 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaa

SEQ ID NO: 430790 - DNA, 4428 bp, Homo sapiens
ctcaggggccttgggtacctttaggttcaggtacaataaagacatgagactggatttgcgtgcatcctaaaagaatcacttttaaataagttttatatgttttcatcttgattcttctagattcatcttgattcaaattagatggttggcatttaaaaagaaagttgcatttctaaatgtagatttgtttaaaaatgaagttgcttgggatttgttgggttttttcctttgcagtgttgaaaacaaagaaagtcaattcgagactattaaaaaagtcaatttgagactatttggtgagaatgtggtaactttgatacacataaggctgttacacttatgattttctaataacttctgaaagttctgtttaaaacagagtcagcctttccagttgctttctgtttgactattctcatgaaataaatggttaccaaacttcacttgccacattctatcatcaaagtgattgaatatattaaggcagatgctaggtaaataaacttgactttggtgaaagaaatacaaatgacattggtaataaacacatctttaaagttgtatgtcccttgaaagaactcttttagaactgttcatacaggtctctctagctggtttataactaatcattctcccaaaaatgatacagtaatcttaacacccacagcacctgtgcataattttgtttctggcactggtatatcagccagaataaaatgactctaccagtataccaactgttatataggagaagtattttatactcttttgccaccaatatctttgattcttacatgttccattacatatgacatgtaattatacagtgtattgtgacttattggtgatgattacagtcattcctagagtctagtaaattggctcccattgcttgtgttgctgagatctggacaataacttaacgaggtgaatgagagaagttgactcaagtaatcttagatatttatagctagttttttctcactttctctcatttccttcactccccgaatcctaccagaaccacagtgacagcaatgcagattcaggaactatgcatgaaatcctctccttccacacatatccatcttttgggggtgggtgggtctttaaaaacaaaatgcgggctataattatttattgaccgtgttataaaacagtcttggatgcttcattcatcaatattgtcccttgaaaataatctccattctcttccaaattaaggtttggtttggttttgttttgttttaatcttctagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430791 - DNA, 3020 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaaaaaaaaaaaaaaaaaaaaaaaaaaaaaaaaaaaaaaaaaaaaaaaaaaaaaaaaaaaacaaaaaaaaaaaaaaaaaaaaaaaaacaaaaaaaaaaaaaaaaaaggaggagggggggggcaggcgaactaaatcatcccccgacaggaggacaacaccaagtccagccgccgccgcagccacgtttctgtgatgagaagggggcggcctgctcacaggggggctggagatgtagttacaaaaatgagaggaggacgagggggtgctattgatcaaaaaacaaaagacagacactacggggagagcaaaaaagtagtcattctttgagatataccaatttttggtaggaaacaataaccatccttatccttgggaacgagtggtgtacactgataacacactgggggaaacgaaaaaaatcatagccaataaaaggataatctgatgcccatgccgaggacataataaaaaacatattgctcgatgttgaactgtgggaaaaaaaacagagtactattttatgtcggcgcgtaaaaagtatgtagtccgaggtgatgattttactacaaacatttccc

SEQ ID NO: 430792 - DNA, 3673 bp, Homo sapiens
tgatctttctttggaaagttctgggattgactcatttgttgctgcttgttccactgccacttgtttctgtttctttgctgcctacctttctgatgtagaaacactctgctgtcttcaggttctctaagacttttgcttctgacaataacaaggcaaaagtaaaaagtaccaaaagagggatacgttatgaaataggaaagcctttaccttagtaatactcttgttccctctccaaagattgtgtgtgtggttttggcgtagttggtatagttgggcttttcttcaacagcatgtacatgctgtgcttactgtcagtttaaaggcagtttgtaatataaagagataccttaagggtcacatgttagaatgctcacagacttcctacaaatggagtattaggtgttcttcagtggcaaaaaggatatccaagatgtcatactttttctttattacaaacgactatccttcaaaacaggctaaagtgttatgtttctgaaagccagatgtggattggttcagttatacctattaagtgcttaaaacttaaatgtaaattatgtatgtgcttttttgtaagggagtgtttagacatttctgatgattagtcttctacttgtctaactttcttaatttggatttcagattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430793 - DNA, 2454 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaaaaagcaacacaccacaaaaacatgttttgggcgcccggggccccgaaaaggttctaaacactcgtgtgggcagggcccacctggttaacaacagggcaaacgggtcccagaaaaccgggcaaaaaagggtggtactcca

SEQ ID NO: 430794 - DNA, 2891 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaaaaaaaaaaaaaaaaaaaaaaaaaaaaaaaaaaaaaaaaaaaaaaaaaaaaaaaaaaaacaaaaaaaaaaaaaaaaaaaaaaaaacaaaaaaaaaaaaaaaaaaggaggagggggggggcaggcgaactaaatcatcccccgacaggaggacaacaccaagtccagccgccgccgcagccacgtttctgtgatgagaagggggcggcctgctcacaggggggctggagatgtagttacaaaaatgagaggaggacgagggggtgctattgatcaaaaaacaaaagacagacactacggggagagcaaaaaagtagtcattctttgagatataccaatttttggtaggaaacaataaccatccttatccttgggaacgagtggtgtacactgataacacactgggggaaacgaaaaaaatcatagccaataaaaggataatctgatgcccatgccgaggacataataaaaaacatattgctcgatgttgaactgtgggaaaaaaaacagagtactattttatgtcggcgcgtaaaaagtatgtagtccgaggtgatgattttactacaaacatttccc

SEQ ID NO: 430795 - DNA, 3470 bp, Homo sapiens
aacagaatctttaacccagtcactgtgtgttagtcaagaatgcaatacttgtttttctttgtttctgttttgggattggcttttggctttttgtgggttttctagacccaaatttagcactagcaaatttcttaaacttccatttgataagtttaatcactgttgagtttgttggccaggaacaaggcagggtttaccaggcttttttgctgcacactcacaatgattacagttctccctaggcacccaggcatcttccttcagcctgaggaaaaaaaagattggtcagctaggtttcttggttttcctttaagaaaactggtttaagaatgtagtattaaggtcattccttttcatagaagttaaatatttctacataccaggcaactcagtgattggccattttagatagtaccttgttccactagcattttttatgcatcaaatcatctcacaatgttgaacaccattggcatctctgtatttgactggttggttagtctaattcatcaaaccaggattcaggtattttgcttaataatgtaatataatcatgaaatttccatttatgcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430796 - DNA, 2696 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggtatgtatctatgctgattggtttttttaagcaatagtaggttggctcaccaaattaataagaaaggaggtttttatgttattgtttttgtggaagacaaagtattatattttattataaaatgtccaattgctgacctggcctaccaaaataagatacaaaacaagtgtctacgtcataaacacggggcctgtgtatacatagggagaaatattacgtaagtatagtgattgacagcaagtttgtatacactttatccaaaagcaaactatgttactttaatataaaatgtgaaaacaaggtgacttgatttggattacataataaatggtgaaaccttgatttaaccaagttttctgattcaaatcaaccaaactagaaaaatttacagtacactaaagtagttcatatgatctaatggtctttagcatacaaaagtacatttatatttgtgaactcaagttaaaaaatttttggtttttaagccacttgatcaaaaaaaactttagacagaactattcatgaatattcatattattagaaaaaagtacactaaacatgagtgcactattacttcctattttgattctttatactacatcacaattactgcttataacatgttacttttacatttattaaggttttgagccagaattgaaataactttgttaccgttaatgaaaaaatatgtttgtaaatcaaacttttagaattagatccctttatatagcctgttaggcaattatttgagtaagctttgtgtaactcttgtacctactaagattttggcagatttagtttatcctagatgagctaaagtcacttcaaactaaaagtaaaaatctaagtgtgatttttaaaagacactgatttaagagtatgtgaatgatagtagaataaactagaaaataattcataatcatctaggcaatttgatttaagagtaggaactagtattcccttaaatttaaatttgtgaaagaaaatgctacagctaaagcactgtggtttgaagcaaca

SEQ ID NO: 430797 - DNA, 3088 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagaggtatgtgttttatattaaaagtttcaataaggcatttcttataattaagtttgtttatgtttgataaagaacacaatataaatacaattttaagtctttgtaagtgtttatgttggtataaatctctgtgcattgcttaaagtttagaaataatagtagtttaaaatacagaggtgccagccaagccatacttactcttccagttgtcattggccaccctgaatgatgaatctaaagaagtatcattgtgaaacaaggaaatgtcagtcaagaaatattccttggaatataaaacaaagccttgactctgctggcataggtctgagttttcataaactggagcttcacaaatctgtaaaactcataatattaatgggtgctttttcagaaattatagaatagctgccacctcttctaaattaagcattgactgtcatcagtattagatttagccagatagtataagtgttatgcaggcgtacctcattttattgtgctttgcaaacattgcatttttttacaaattgaaggttgtggccaccctgtgttgagcaagtctgttggtgctatttttccaacatgtattcacttcatgtctgtgtgacacatactggtaaattctcacaatatttcagactttgtcattatatctgttatggtgatctgtgattagtgatcttcgatgttactactgtgattgttttagggcaccacagggcacacccagataaggcagtgaacctaattgataaatactgtgtgtgttgtgactccttcaccagttacccattccctttctctgctcacttcaagtttccctatgccctgagacacaacagtatttaaattaggtcaattaataaccccacagtggcctctgagtattcaagtgaatggaaaagtcacatccctctcattttaaatcaaaacctagacatgattaagtttagtgaggaaggcatgctgaaagctaaaataggcctcttaaggcaaacagtaggccaagttgtgaatgcaaaggaaaagttcttgaagaaaaatcaaagtgctactccactaagcatatgaataagaaagtgaaacagctttattgctgctagggagaaagtttgaatggtctgaatagaagatcaaagcaaccacaacatttccttaggctaaagcctaatccagagcaaggccctcgtttcaattctgtgaagcctaagagaggtgatgaagctgcagaagaaaaattggaagctagcagaggttggttcctgtggtttagggaaagaagccatctccatgagtgcagaatgaagcagcaagtgctgatgtagaagctgctgcaagttacccagaagatctagctaagatcattgatgcaggtgactaaacagattgtcagtgtagaggaaacagccttccattggaagaaggtgccgtctaggactttcataactagagagaagacaacatctgctttgaaaggacatgctaactctcattagtggataatgcagctggtcacttttaagtggaagctagtgctcatttatcattctgataatcctaggacccttagaatttgctgaatctactctgcctgtgctttataaatggaacaacaaagcctggatgacagcatgtctgtttacatcatagtgtactgagtattttaagcccactgttgggaccgactgctcagg

SEQ ID NO: 430798 - DNA, 1597 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttggggaattaaccttccttccaagggaaccccattttgcctgaattccccaaccaaaaaaggt

SEQ ID NO: 430799 - DNA, 3034 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagaggtatgtgttttatattaaaagtttcaataaggcatttcttataattaagtttgtttatgtttgataaagaacacaatataaatacaattttaagtctttgtaagtgtttatgttggtataaatctctgtgcattgcttaaagtttagaaataatagtagtttaaaatacagaggtgccagccaagccatacttactcttccagttgtcattggccaccctgaatgatgaatctaaagaagtatcattgtgaaacaaggaaatgtcagtcaagaaatattccttggaatataaaacaaagccttgactctgctggcataggtctgagttttcataaactggagcttcacaaatctgtaaaactcataatattaatgggtgctttttcagaaattatagaatagctgccacctcttctaaattaagcattgactgtcatcagtattagatttagccagatagtataagtgttatgcaggcgtacctcattttattgtgctttgcaaacattgcatttttttacaaattgaaggttgtggccaccctgtgttgagcaagtctgttggtgctatttttccaacatgtattcacttcatgtctgtgtgacacatactggtaaattctcacaatatttcagactttgtcattatatctgttatggtgatctgtgattagtgatcttcgatgttactactgtgattgttttagggcaccacagggcacacccagataaggcagtgaacctaattgataaatactgtgtgtgttgtgactccttcaccagttacccattccctttctctgctcacttcaagtttccctatgccctgagacacaacagtatttaaattaggtcaattaataaccccacagtggcctctgagtattcaagtgaatggaaaagtcacatccctctcattttaaatcaaaacctagacatgattaagtttagtgaggaaggcatgctgaaagctaaaataggcctcttaaggcaaacagtaggccaagttgtgaatgcaaaggaaaagttcttgaagaaaaatcaaagtgctactccactaagcatatgaataagaaagtgaaacagctttattgctgctagggagaaagtttgaatggtctgaatagaagatcaaagcaaccacaacatttccttaggctaaagcctaatccagagcaaggccctcgtttcaattctgtgaagcctaagagaggtgatgaagctgcagaagaccatgagtgcagaatgaagcagcaagtgctgatgtagaagctgctgcaagttacccagaagatctagctaagatcattgatgcaggtgactaaacagattgtcagtgtagaggaaacagccttccattggaagaaggtgccgtctaggactttcataactagagagaagacaacatctgctttgaaaggacatgctaactctcattagtggataatgcagctggtcacttttaagtggaagctagtgctcatttatcattctgataatcctaggacccttagaatttgctgaatctactctgcctgtgctttataaatggaacaacaaagcctggatgacagcatgtctgtttacatcatagtgtactgagtattttaagcccactgttgggaccgactgctcagg

SEQ ID NO: 430800 - DNA, 3033 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagaggtatgtgttttatattaaaagtttcaataaggcatttcttataattaagtttgtttatgtttgataaagaacacaatataaatacaattttaagtctttgtaagtgtttatgttggtataaatctctgtgcattgcttaaagtttagaaataatagtagtttaaaatacagaggtgccagccaagccatacttactcttccagttgtcattggccaccctgaatgatgaatctaaagaagtatcattgtgaaacaaggaaatgtcagtcaagaaatattccttggaatataaaacaaagccttgactctgctggcataggtctgagttttcataaactggagcttcacaaatctctcttctaaattaagcattgactgtcatcagtattagatttagccagatagtataagtgttatgcaggcgtacctcattttattgtgctttgcaaacattgcatttttttacaaattgaaggttgtggccaccctgtgttgagcaagtctgttggtgctatttttccaacatgtattcacttcatgtctgtgtgacacatactggtaaattctcacaatatttcagactttgtcattatatctgttatggtgatctgtgattagtgatcttcgatgttactactgtgattgttttagggcaccacagggcacacccagataaggcagtgaacctaattgataaatactgtgtgtgttgtgactccttcaccagttacccattccctttctctgctcacttcaagtttccctatgccctgagacacaacagtatttaaattaggtcaattaataaccccacagtggcctctgagtattcaagtgaatggaaaagtcacatccctctcattttaaatcaaaacctagacatgattaagtttagtgaggaaggcatgctgaaagctaaaataggcctcttaaggcaaacagtaggccaagttgtgaatgcaaaggaaaagttcttgaagaaaaatcaaagtgctactccactaagcatatgaataagaaagtgaaacagctttattgctgctagggagaaagtttgaatggtctgaatagaagatcaaagcaaccacaacatttccttaggctaaagcctaatccagagcaaggccctcgtttcaattctgtgaagcctaagagaggtgatgaagctgcagaagaaaaattggaagctagcagaggttggttcctgtggtttagggaaagaagccatctccatgagtgcagaatgaagcagcaagtgctgatgtagaagctgctgcaagttacccagaagatctagctaagatcattgatgcaggtgactaaacagattgtcagtgtagaggaaacagccttccattggaagaaggtgccgtctaggactttcataactagagagaagacaacatctgctttgaaaggacatgctaactctcattagtggataatgcagctggtcacttttaagtggaagctagtgctcatttatcattctgataatcctaggacccttagaatttgctgaatctactctgcctgtgctttataaatggaacaacaaagcctggatgacagcatgtctgtttacatcatagtgtactgagtattttaagcccactgttgggaccgactgctcagg

SEQ ID NO: 430801 - DNA, 1183 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacaggtaaaaaattctgttcattttttaaaactactaattttttcactcttgtatttgtaactcagtgacattttacctaactgcagagccaggtacctacagtacatcttcatgaacttgagcaacacaaattca

SEQ ID NO: 430802 - DNA, 2148 bp, Homo sapiens
gaacggagatcacaccaatgcactccagtcctggagtgacagagcaagacgccgtctcaaaaaaaacagacattacccattactctacctttaataagattcaaaattatataccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagaggtatgtgttttatattaaaagtttcaataaggcatttcttataattaagtttgtttatgtttgataaagaacacaatataaatacaattttaagtctttgtaagtgtttatgttggtataaatctctgtgcattgcttaaagtttagaaataatagtagtttaaaatacagaggtgccagccaagccatacttactcttccagttgtcattggccaccctgaatgatgaatctaaagaagtatcattgtgaaacaaggaaatgtcagtcaagaaatattccttggaatataaaacaaagccttgactctgctggcataggtctgagttttcataaactggagcttcacaaatctgtaaaactcataatattaatgggtgctttttcagaaattatagaatagctgccacctcttctaaattaagcattgactgtcatcagtattagatttagccagatagtataagtgttatgcaggcgtacctcattttattgtgctttgcaaacattgcatttttttacaaattgaaggttgtggccaccctgtgttgagcaagtctgttggtgctatttttccaacatgtattcacttcatgtctgtgtgacacatactggtaaattctcacaatatttcagactttgtcattatatctgttatggtgatctgtgattagtgatcttcgatgttactactgtgattgttttagggcaccacagggcacacccagataaggcagtgaacctaattgataaatactgtgtgtgttgtgactccttcaccagttacccattccctttctctgctcacttcaagtttccctatgccctgagacacaacagtatttaaattaggtcaattaataaccccacagtggcctctgagtattcaagtgaatggaaaagtcacatccctctcattttaaatcaaaacctagacatgattaagtttagtgaggaaggcatgctgaaagctaaaataggcctcttaaggcaaacagtaggccaagttgtgaatgcaaaggaaaagttcttgaagaaaaatcaaagtgctactccactaagcatatgaataagaaagtgaaacagctttattgctgctagggagaaagtttgaatggtctgaatagaagatcaaagcaaccacaacatttccttaggctaaagcctaatccagagcaaggccctcgtttcaattctgtgaagcctaagagaggtgatgaagctgcagaagaaaaattggaagctagcagaggttggttcctgtggtttagggaaagaagccatctccatgagtgcagaatgaagcagcaagtgctgatgtagaagctgctgcaagttacccagaagatctagctaagatcattgatgcaggtgactaaacagattgtcagtgtagaggaaacagccttccattggaagaaggtgccgtctaggactttcataactagagagaagacaacatctgctttgaaaggacatgctaactctcattagtggataatgcagctggtcacttttaagtggaagctagtgctcatttatcattctgataatcctaggacccttagaatttgctgaatctactctgcctgtgctttataaatggaacaacaaagcctggatgacagcatgtctgtttacatcatagtgtactgagtattttaagcccactgttgggaccgactgctcagg

SEQ ID NO: 430803 - DNA, 933 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgaggtaaattgtttttttaattcttatttaacattaattgaataaagaccattgaactgagattacagtttagaatttgttactaataaagctatataatctcctataatttacttaacctttccaggcttcaatttcctcatctataaaatgacagactaaataatctttaaggtttctt

SEQ ID NO: 430804 - DNA, 1030 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtgactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagcaggatatctatcctatggattga

SEQ ID NO: 430805 - DNA, 473 bp, Homo sapiens
  misc_feature (250)..(250): n is a, c, g, or t
gttgagctccaactccaggccccatggggttgcaccaagctgctcaacctcacctgtttcttgaaattttgctgccttccactaggcagatgggtccagcaggagacattggagcaccaaatggaaaagctcttccttccttcccctcttcctgtacatcagaaagaatgcattagaaactcaaggagtgagcatttgggcttcctaagggtgagacagtgtggggctcctgtggggagatgggtactcntgtacccagtgtggcctcctgctcccaccgctttccagctgtggggcttttccttgtggaaattactgtccaagtttgatttttccatctgtaaaaggaggcaagtaagggttggtatgacttaaatgaattactggagtgggtagtgagtgtacttaaatgtttcaattctgttatattttttattaagtttttaaaaaattaaattggatattaaattgta

SEQ ID NO: 430806 - DNA, 5095 bp, Homo sapiens
atagtgttgactgaggttgtctttattagaagtctcagccatgcctccagtttcgagatgaatctcaattcacaagttccactatgaatctcaattcacaagttccactaccaccaccaccatcactgcccccagatagaatgagacttctaataacttgaaagacaagtctataaatatcctgtaatcgttttcactgtatcactttttcctggctacttttatccgataaaaacctcaatttatttttaagctattaaacatgcggacaaagggaatcttagttttatgcaaaaacgcaaccacgcatgagaactgcgcaagtctttcttggaatggtctgtatttgggtgaagtcatcagacgtcattacacttctttattttggggttgccaactcgtttcccaggatttaaagactataacgatgataaaagtcagtgtcgcaccctgtcaaaggcttggcccgttgccttttccttcccggcaatactcggttcaattaggtcttgtcccctcattatctgtgaggactgaattccacccccgcttttcaacgcaggctctttgctcgggaaaagtcaaaccatctctcaaaggatcaaagagctcagccatagacagagccgccggaggaaagcggagtcgctgcatcagatgaaaggggcccctcagcctcactcctcaccgcagctcctgggatcttaaagacagggtcaggaggatcaggagggacaagagggatggaggcgaaaggctggatccttaatccaggccggagacaaagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430807 - DNA, 4288 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggccctttatattcccacccttgtttggcgcgcggagagggggtgatttgggttttt

SEQ ID NO: 430808 - DNA, 5032 bp, Homo sapiens
atagtgttgactgaggttgtctttattagaagtctcagccatgcctccagtttcgagatgaatctcaattcacaagttccactatgaatctcaattcacaagttccactaccaccaccaccatcactgcccccagatagaatgagacttctaataacttgaaagacaagtctataaatatcctgtaatcgttttcactgtatcactttttcctggctacttttatccgataaaaacctcaatttatttttaagctattaaacatgcggacaaagggaatcttagttttatgcaaaaacgcaaccacgcatgagaactgcgcaagtctttcttggaatggtctgtatttgggtgaagtcatcagacgtcattacacttctttattttggggttgccaactcgtttcccaggatttaaagactataacgatgataaaagtcagtgtcgcaccctgtcaaaggcttggcccgttgccttttccttcccggcaatactcggttcaattaggtcttgtcccctcattatctgtgaggactgaattccacccccgcttttcaacgcaggctctttgctcgggaaaagtcaaaccatctctcaaaggatcaaagagctcagccatagacagagccgccggaggaaagcggagtcgctgcatcagatgaaaggggcccctcagcctcactcctcaccgcagctcctgggatcttaaagacagggtcaggaggatcaggagggacaagagggatggaggcgaaaggctggatccttaatccaggccggagacaaagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggagtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430809 - DNA, 6088 bp, Homo sapiens
ataaaggttttaaatagtctataccgtatactaaaactaaattaatatttaggactgaaataacatattgattaagtaccagctatgtacccaaaaaatgctgggcacagaagttagagtaagatgttttacttaaagggcctttgagtgagagttggcaattcattctgaactaaccactaatatcattaagaattagtgctgagttggtagcaggaaataggtaattctgtctaaaggaatcatgaaatggaaaataaataagcttttaataaggagaaggaagagctgaagaaatggcacagtgttcttagaatgacagatagtcctatggggactgcagcataaaagtgaaaaatgtataagataaacctttagatggtaagcaaggcaagattctcaaattctgtatgaatcagctccacctccgccccatggacagtagatgaccgttaatggcttttaaggaaagatgcaacctggaaaaaaagaaaaaaaacttgttttagaatggtaaccactggcaatatgaagaataattagactaaagaagagaggtaggataatcatgggcattggcagtggaattgaaagagtaatttcagaagcagaatggtcagatgttggaggtgattggttatagagtttaagaattgtactgattttctattgtgtaacaaactaccccaaaacttaatggcttaaagcaactattatttctcctgattctgtggttgactggatggtcgtctgctgctcttgcttagacttaggcatctgcatttagctgagggttcagccagggctggacatcctttaatggcctcattcccatgtctggggcctcaggtcagatagctgggactaccgggtctcactccagaagaggcttcttcagagcatggtagtcttggggttctaagagaatgagagtagaagctgcaaaacctcttgaaactggggcttgggagtcacacatgactttctccacattctgttcgtcaaaagcgaatcataaggacagcacagactcaagggataagaaaggagattccatctcttgatgagaagagctgcaaaggccatatttaatcagtcacaggagtctaatgctacaaagtagttttttaaaaagatgactagattggcaagttcaaggttaatctttttatttgttttatttatatatcacttagctggtattcagtaaaagcttgctttgtaaaatttagttaatatctttttggttcagcacagacattgcatcatcttagcagctctttttcaaacagatttgaagctgcttcaaataacaatctggtttataaaatgaaaatagaaaattatgatcttagaatgaagaagtgaatttctaagccatgataattattacggttgctgtgattagacagacttttctgtggagcttcctgacaaccaagaaaaaaggggaaatcaaggaactgttcttatcagaaagtaggaacccagcaattctttcattttctcattgggaacttaatagtcactgaattacaaagtagacagtgaccttgattatacaacatatgcggaagtgtttcctgtaacttacgtgagtattttatcaaatacttatatatttgataaaagctaagtacataaagcataactcagtagatagaattctctagtagtaagctaaagtgcttcaagtattagttgtcatattaatccaagagaaaattagatctgagactacctcgaggagtaaacgaacaacttctttaaaccaatactagtcaaaatgcagtccacggaccaatgctggttcatgccctatttgatccaagtccacattaagtacagaaatgaagagtaagcatttagaaacttggggcaatttgacattgcctcaacatccaagtttcagtgtcctttataaactattgatccatgacagatcatgaaactttctaaaaattgatccttttatcacatagtctttcaaaatattatttgcttctttgaagctttggatagaaacttgataatgtgaagttctctgctatgtggacctggtgtgcttatcttctttgttgctgatttgagagctgagctatgtactatatctggaatgcacacagcaggcatcctgctgcgcagttctgtgtctagttaatagtatggaagttcaggaacatacctccaaaaaaaaaaaaaagctaggattttcctcagaaagaatgcagtattttatgtcttaatatttgtggttaattttgttactacagaactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430810 - DNA, 4515 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagtacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430811 - DNA, 3276 bp, Homo sapiens
ggctgcaggaattggcacgagcatcaatattgtcccttgaaaataatctccattctcttccaaattaaggtttggtttggttttgttttgttttaatcttctagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcagacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatcacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 430812 - DNA, 553 bp, Homo sapiens
ctattacagtattaaacccttaatattatctacagggtagattcttttacctccattttacaaaccaggaaagtaaagaggctatataacttgcctacagccattagtgatggggctgggatttgaatccagtaaatctgatttgaggtgtctttgacaagctcaggcttgcagaggtggtttggggtgctcaaaattcccatcagccccagttgatttggtgttacatacaatcttacgtaagtactatgccaatacaccttcataaccaacccccagcctccccttccaagcgcatttgtaccactgagttctatatacagaagttgtagatctgtcactaccagactgtaacttaaatacaccatacagaatggagagcagtgttggactcacagttagtgttagttattattagtattgatactagtgttggtactattgctggttgacatgtgacagtacttagtaaactgcataaattgtgaggatcactattatcactcttattactagtaattgcaataaagttcagtggaagcaacaagagata

SEQ ID NO: 430813 - DNA, 348 bp, Homo sapiens
atcctcccgcctcagcctcccaaagtgctgggattacaggcatgacccaccgtgaccggcctattacagtattaaacccttaatattatctacagggtagattcttttacctccattttacaaaccaggaaagtaaagaggctatataacttgcctacagccattagtgatggggctgggatttgaatccagtaaatctgatttgaggtgtctttgacaagctcaggcttgcagaggtggtttggggtgctcaaaattcccatcagccccagttgatttggtgttacatacaatcttacgtaagtactatgccaatacaccttcataaccaacccccagcctcccctt

SEQ ID NO: 430814 - DNA, 405 bp, Homo sapiens
gatttgaggtgtctttgacaagctcaggcttgcagaggtggtttggggtgctcaaaattcccatcagccccagttgatttggtgttacatacaatcttacgtaagtactatgccaatacaccttcataaccaacccccagcctccccttccaagcgcatttgtaccactgagttctatatacagaagttgtagatctgtcactaccagactgtaacttaaatacaccatacagaatggagagcagtgttggactcacagttagtgttagttattattagtattgatactagtgttggtactattgctggttgacatgtgacagtacttagtaaactgcataaattgtgaggatcactattatcactcttattactagtaattgcaataaagttcagtggaagcaa

SEQ ID NO: 430815 - DNA, 622 bp, Homo sapiens
ggctggaggcacgtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagccca

SEQ ID NO: 430816 - DNA, 731 bp, Homo sapiens
gggcagaggggggccgggaagggacctggctggggaatgagaaaacctggggccatcgtcaacccagagacttgggtttgcaggtgaagggtatcgggccgtccatccctctagcatgcttctcacgacttgcatctttacccactagacttctgcgctgacccaggggctggagcgaatcccagaccagctcggctacctggtactgagtgaaggtgcagtgctggcgggcagcaagtgtgaagacagaaaaagatggagccattaacagtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagccca

SEQ ID NO: 430817 - DNA, 970 bp, Homo sapiens
ggctggaggcacgtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctggtgagcccctgcccctgcccttggtggtggtactgggagcggggggctacttccaggggcttctcggcttctcttcttccagcctcctaccatctcctggggtctctggtctggccactttcctccctttgggactccctggtatcagaattgtgaatgagaaggcaagagaaaggagatctagcagaggccactcatcttcaaatctctgagcctggaactatagaacttctttggctttgatcccagccaatgtgcgtgtggccccgccccatggagtctgttgcacccactaactctgtgctcccttccctctcctggggcgggggaaggtgtgtctctcctccatggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagccca

SEQ ID NO: 430818 - DNA, 742 bp, Homo sapiens
gtctgcaagaatcttcagcgtttttgcgtgatctaaaccctcagggcatccgactgcccctgcctgtacctcattgtcaaactccacgaagcgaggtcatgccgcccgggtaccagacggacctccttgaagccagggaactgattgaaaagcatggacagcatgagctcgttggtctcctctggcaggttggcgatgacaacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagccca

SEQ ID NO: 430819 - DNA, 541 bp, Homo sapiens
ggctggaggcacgtgaccggggcctgaagccggaagctacctatctggtagggagctcccccagcaccgaagactgcgatgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagccca

SEQ ID NO: 430820 - DNA, 647 bp, Homo sapiens
ggctggaggcacgtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagcccaaaacacgacacaaaatctcagcgct

SEQ ID NO: 430821 - DNA, 664 bp, Homo sapiens
  misc_feature (655)..(655): n is a, c, g, or t
ggctggaggcacgtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagcccaaaaaaaaaacaacaaaaaacaaaaaaaaaaaanccccggggc

SEQ ID NO: 430822 - DNA, 766 bp, Homo sapiens
  misc_feature (31)..(31): n is a, c, g, or t
  misc_feature (40)..(40): n is a, c, g, or t
  misc_feature (46)..(46): n is a, c, g, or t
cgcgcccccccgagcccaaaaatacggctangtcgaggcngggtgntacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagcccaaaaaaaaaaaacaaaaaaacaaaaaaacacaaccacacagcaaaaacagcacgagagagacaaaacaaagaaaaaacagccgggcgcattagtcgggggcacacaaaagagtacgggccagcgtcacaggtccacaccattttaacagagcacggcgcccaagggggaatatcggagg

SEQ ID NO: 430823 - DNA, 719 bp, Homo sapiens
gggcagaggggggccgggaagggacctggctggggaatgagaaaacctggggccatcgtcaacccagagacttgggtttgcaggtgaagggtatcgggccgtccatccctctagcatgcttctcacgacttgcatctttacccactagacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagcccaaaagagaaagaaaagaaattctccagcgct

SEQ ID NO: 430824 - DNA, 270 bp, Homo sapiens
aaaccgcaggctgtgctgaccagctcagagatggcactggctgcctgctcatcattctccaggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagccca

SEQ ID NO: 430825 - DNA, 607 bp, Homo sapiens
ggctggaggcacgtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcggtgcgttctgggaaagggagggggtcccttagtgcacacagcccggtaaccccttctaatattggcccttcttttctcggcttttatctggtttcctgcctggcatctattaggttggtacaaaagtatttgcagtttttgcaattactttcagtaatcagtctgtggaatcttattctcctaacggctgcgatttatttatttatagtttttgagactgagtttcgttcttgttgcccaagctggagtgcagtggtgcgacctcggctcactgcaacctccgcctccggggttcaagcgattctcctgcctcagcctcccgagtagctgggattataggcacgtgccaccatgctctgctaattttttgtatttttagtagaaacggggtttcaccgtgttggccaggctggtctcaaactcctgacctcaggtgatccagctg

SEQ ID NO: 430826 - DNA, 674 bp, Homo sapiens
gggcagaggggggccgggaagggacctggctggggaatgagaaaacctggggccatcgtcaacccagagacttgggtttgcaggtgaagggtatcgggccgtccatccctctagcatgcttctcacgacttgcatctttacccactagacttctgcgctgacccaggggctggagcgaatcccagaccagctcggctacctggtactgagtgaaggtgcagtgctggcggtgcgttctgggaaagggagggggtcccttagtgcacacagcccggtaaccccttctaatattggcccttcttttctcggcttttatctggtttcctgcctggcatctattaggttggtacaaaagtatttgcagtttttgcaattactttcagtaatcagtctgtggaatcttattctcctaacggctgcgatttatttatttatagtttttgagactgagtttcgttcttgttgcccaagctggagtgcagtggtgcgacctcggctcactgcaacctccgcctccggggttcaagcgattctcctgcctcagcctcccgagtagctgggattataggcacgtgccaccatgctctgctaattttttgtatttttagtagaaacggggtttcaccgtgttggccaggctggtctcaaactcctgacctcaggtgatccagctg

SEQ ID NO: 430827 - DNA, 921 bp, Homo sapiens
  misc_feature (373)..(373): n is a, c, g, or t
gggcagaggggggccgggaagggacctggctggggaatgagaaaacctggggccatcgtcaacccagagacttgggtttgcaggtgaagggtatcgggccgtccatccctctagcatgcttctcacgacttgcatctttacccactagacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctngtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatggccttctacctttgggtttacagcccctccacactctgaaaaaaaaaaatgactagacagatacggaccaaagaaacagagg

SEQ ID NO: 430828 - DNA, 700 bp, Homo sapiens
ggctggaggcacgtgaccggggcctgaagccggaagctacctatctggtagggagctcccccagcaccgaagactgcgatggtgagtgaggacgcatgcgcgagaggacccgccgggggttcagcgtctctgctccccagtctgtgtggtttccccctgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagccca

SEQ ID NO: 430829 - DNA, 666 bp, Homo sapiens
ggctggaggcacgtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagcccaaaaaaaaaacaaaccaaaccaccaatactaactaaacaaaaagg

SEQ ID NO: 430830 - DNA, 660 bp, Homo sapiens
ggctggaggcacgtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagcccaaaaaaaacatctatcaatatatgacaacacacaaaaaa

SEQ ID NO: 430831 - DNA, 742 bp, Homo sapiens
  misc_feature (733)..(733): n is a, c, g, or t
ggctggaggcacgtgaccggggcctgaagccggaagctacctatctggtagggagctcccccagcaccgaagactgcgatggtgagtgaggacgcatgcgcgagaggacccgccgggggttcagcgtctctgctccccagtctgtgtggtttccccctgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagcccaaaaaaaaaacaacaaaaaacaaaaaaaaaaaanccccggggc

SEQ ID NO: 430832 - DNA, 854 bp, Homo sapiens
  misc_feature (306)..(306): n is a, c, g, or t
ggctggaggcacgtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctngtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatggccttctacctttgggtttacagcccctccacactctgaaaaaaaaaaatgactagacagatacggaccaaagaaacagagg

SEQ ID NO: 430833 - DNA, 4414 bp, Homo sapiens
cagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatg

SEQ ID NO: 430834 - DNA, 3771 bp, Homo sapiens
cagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaatcactaaaaattcccacaaatcttgtttctggcactttagaaaaactgcaaaaaaatacgtaataaagaatacatatatatatatctac

SEQ ID NO: 430835 - DNA, 2276 bp, Homo sapiens
cagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgcacaccagcaaagaacaagatcctct

SEQ ID NO: 430836 - DNA, 2225 bp, Homo sapiens
cagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatttgcttcctagcacattccattctttgtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatg

SEQ ID NO: 430837 - DNA, 342 bp, Homo sapiens
  misc_feature (11)..(11): n is a, c, g, or t
  misc_feature (94)..(94): n is a, c, g, or t
gataaatattnggtcagtttctctaaatctgggtcctcactacgtatagagctagtctgtagaattctaaattttgcgtgctgcggcacagaanccagtggccttctcactctgccaccacccgtcttcccagggaacatggggaaagagggcacgaactgacaagacttgatcattttcaaaagacaaaactgcaaaatcccaaatttccaacatctgaaactcacaatattcaaattccccagctcaaatacatatattttaatctccacgtcgccacaatctcatttgttgcccagaaccaccacattctggaagctagagattgttagcgcgtgctgt

SEQ ID NO: 430838 - DNA, 4434 bp, Homo sapiens
cagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatgaactgtgctccacaaaaaaa

SEQ ID NO: 430839 - DNA, 4710 bp, Homo sapiens
cagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatgttataagtcaaaaaattgcctttgtcctttaaaaaggtctttttttgacatagaaaaatattattcgggggggggccccgtacccaatttgccctatagtgagccggttaacaaattaatgggggtctttttaaataggggggacggggaaaaccctggggtttcccaacttaatcgctttttgaaaaatcccctttttttaaacttggggtaaaaaaaaaaagggcgggaccggattgcctttttccaaattttaacaatccttattggcgaatggggaaattctaaagcgtcaa

SEQ ID NO: 430840 - DNA, 4360 bp, Homo sapiens
cagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcgaaactgaccaatatttatctccgcatttgtgtgtgtgtccaactctgtaggccaataaaccaacaagacaaatg

SEQ ID NO: 430841 - DNA, 1819 bp, Homo sapiens
  misc_feature (11)..(11): n is a, c, g, or t
  misc_feature (94)..(94): n is a, c, g, or t
gataaatattnggtcagtttctctaaatctgggtcctcactacgtatagagctagtctgtagaattctaaattttgcgtgctgcggcacagaanccagtggccttctcactctgccaccacccgtcttcccagggaacatggggaaagagggcacgaactgacaagacttgatcattttcaaaagacaaaactgcaaaatcccaaatttccaacatctgaaactcacaatattcaaattccccagctcaaatacatatattttaatctccacgtcgccacaatctcatttgttgcccagaaccaccacattctggaagctattttccttgatcatatttaagaaaaaaaaaatgtctacaatctcaattctcccaaaaaaaaatgtccatggttttggaattttgacctattctgaagttccaattctccggtccatcctcaacccttccattttcccatgcctgtttgcctcagaggagtatgggttaaggatataggggcactgtcgtcacctctgcccctgcctccaggccttcctcagtctctcttgtggttccgctgtatagatagatagatatataatttgtgtgtagatatatatatatgtattctttattacgtatttttttgcagtttttctaaagtgccagaaacaagatttgtgggaatttttagtgattttttttttgtgtgtttttccccatttgaaacctttcccccccttaaaaattggaacttggtacattcagtaggaaattcgtcactcaggctgtggccaagaccaagaaaagtgcaaagagacagaggaggaatgaaggagtgactcctctgtggttaacattcagggagcctgtctaaaacctccccttttgtatatgctgggagggtatgaggggtaggaggatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatgaactgtgctccacaaaaaaa

SEQ ID NO: 430842 - DNA, 956 bp, Homo sapiens
  misc_feature (11)..(11): n is a, c, g, or t
  misc_feature (94)..(94): n is a, c, g, or t
  misc_feature (950)..(950): n is a, c, g, or t
gataaatattnggtcagtttctctaaatctgggtcctcactacgtatagagctagtctgtagaattctaaattttgcgtgctgcggcacagaanccagtggccttctcactctgccaccacccgtcttcccagggaacatggggaaagagggcacgaactgacaagacttgatcattttcaaaagacaaaactgcaaaatcccaaatttccaacatctgaaactcacaatattcaaattccccagctcaaatacatatattttaatctccacgtcgccacaatctcatttgttgcccagaaccaccacattctggaagctattttccttgatcatatttaagaaaaaaaaaatgtctacaatctcaattctcccaaaaaaaaatgtccatggttttggaattttgacctattctgaagttccaattctccggtccatcctcaacccttccattttcccatgcctgtttgcctcagaggagtatgggttaaggatataggggcactgtcgtcacctctgcccctgcctccaggccttcctcagtctctcttgtggttccgctgtatagatagatagatatataatttgtgtgtagatatatatatatgtattctttattacgtatttttttgcagtttttctaaagtgccagaaacaagatttgtgggaatttttagtgattttttttttgtgtgtttttccccatttgaaacctttcccccccttaaaaattggaacttggtacattcagtaggaaattcgtcactcaggctgtggccaagaccaagaaaagtgcaaagagacagaggaggaatgaaggagtgactcctctgtggttaacattcagggagcctgtctaaaacctccccttttgtatatgctgggagggtatgaggggtaggaggatggtcctggccctccctaaactcacctccctccaaaagccatgantcttgc

SEQ ID NO: 430843 - DNA, 2817 bp, Homo sapiens
cagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatgaaaggactcgacatgaatcatgtcgagtgctttcatcccagcctaagagacagagcaagactccatctc

SEQ ID NO: 430844 - DNA, 2566 bp, Homo sapiens
aggtcggagtcgggactacgcttagcgctcgctcgcggggagaccggcagcggtcttctgtttggtctcttgacaagggggcgggacttccgcagaaagcaagattgggcctatccgcgatgagaacggcgtggagggggaattaaggctggaactggagagggaggggtctgcggtcagtcggacgcggcgctggaaatccggcggaggacctagaagtagcgggagcgatctgtgggcggggcgaacggcctgccggccgacggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430845 - DNA, 565 bp, Homo sapiens
acagcaatactaccccacatttgcatacagctttatgttttacaaagtgctttttcatacattagttcatttatcctcatgtcaatctgataagagcaatatgcattcaagaaattattgcttatttcattacatttcttagataaccattgaccacacctccaaaacccattttacagaaatccagccagaatcatgagtctgaatacatgactgttcttaagattcctgcctacctggaggctctaatcctgtgctcttgtaccctggcctgtattgtagtggtggtgcagactttccgagacctggtttggttgtgtcctcagtgtactgaagctgtatgtcaggccctgcccggctgtgaagagaacattcaagatagtgaggtagactgtaattctcctttacttctaggtagggggagaatgcttgaaaccctgccctttgaaatggaatctaattattctctctaccctgtgtttgaagtgggcactcttcgaattgattgccaccttagattctcttttggatatagatggcatataaattataaaaacaagattta

SEQ ID NO: 430846 - DNA, 2405 bp, Homo sapiens
ggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430847 - DNA, 2587 bp, Homo sapiens
aggtcggagtcgggactacgcttagcgctcgctcgcggggagaccggcagcggtcttctgtttggtctcttgacaagggggcgggacttccgcagaaagcaagattgggcctatccgcgatgagaacggcgtggagggggaattaaggctggaactggagagggaggggtctgcggtcagtcggacgcggcgctggaaatccggcggaggacctagaagtagcgggagcgatctgtgggcggggcgaacggcctgccggccgacggtagggcctgaagagcctagggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430848 - DNA, 3488 bp, Homo sapiens
ggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcataggtgggtttttcagaaggaaatagtatttgccatgacccatagtaaaaattcttaatagctttcattgtttggtgagtcacgtctgggacccgagaagaaaatgtgaatgcttcctaggttttcctctctccttcatttttttctcctattatggttggcacaagagtaggaggaaagtggttttgtttttaatgaagtcaatctgttgtcttacctcagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggtaaaaacagtccttaccttaaatcttgtcatgataaatctttaccttttcaatgattggtggaaagtagagtatcttagcactaaacctcagactgttgcctgaatttgaagcatttgtgagcaagaaagaggttcgtcactggttatttcagccatttgtccaaaaataaaagtcacattgtgtacatttgggaatttggataaaaaacttagctcctacagattaagaacatctttcacacaagttttctgtctcttttaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaactgataggggtcatcatttgtgggggtcatcttttcttccctggattattatagtaaattcctaactgttctcatatttccaatcatgcttttaggccagattccaaagtccttaatgtcatctaaagtacctctttggtgtcaagtcttgccactcccaaaatgacttcttttctggcagaagcaaaccatttgcattgcagttccctttatacacctgcttctttcacctctgtgttaacttaaacctgcttttatttattgcctggaacattttctcaccctcat

SEQ ID NO: 430849 - DNA, 2341 bp, Homo sapiens
aggtcggagtcgggactacgcttagcgctcgctcgcggggagaccggcagcggtcttctgtttggtctcttgacaagggggcgggacttccgcagaaagcaagattgggcctatccgcgatgagaacggcgtggagggggaattaaggctggaactggagagggaggggtctgcggtcagtcggacgcggcgctggaaatccggcggaggacctagaagtagcgggagcgatctgtgggcggggcgaacggcctgccggccgacggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430850 - DNA, 2277 bp, Homo sapiens
ggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430851 - DNA, 2077 bp, Homo sapiens
aatacggctagtacgaggccggggtgaatcggccgagggtcagcaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430852 - DNA, 2669 bp, Homo sapiens
ggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggtaaaaacagtccttaccttaaatcttgtcatgataaatctttaccttttcaatgattggtggaaagtagagtatcttagcactaaacctcagactgttgcctgaatttgaagcatttgtgagcaagaaagaggttcgtcactggttatttcagccatttgtccaaaaataaaagtcacattgtgtacatttgggaatttggataaaaaacttagctcctacagattaagaacatctttcacacaagttttctgtctcttttaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430853 - DNA, 1884 bp, Homo sapiens
gtgtcttaaaatgtaaggaacctggacccagtgtatgctgatcatgtctttggtcttagaggagtgtgcatttgtattaacaactcatcttggaattttaagccttttttgtgtaaactttaaatagtacatgaaaagtgacttaattatggcacagcctatttttaagaattctccctttgctatgatgaacaaccacctggtcatatggcagtggcatggaaatggtcctaattttgttgctaaaatagctcttttgttttgttttttggatagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430854 - DNA, 1186 bp, Homo sapiens
gtgctcgcttcggcagcacatatactaaaattggaacgatacagagaagattagcatggcccctgcgcaaggatgacacgcaaattcgtgaagcgttccatatttttgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430855 - DNA, 1309 bp, Homo sapiens
acagcaatactaccccacatttgcatacagctttatgttttacaaagtgctttttcatacattagttcatttatcctcatgtcaatctgataagagcaatatgcattcaagaaattattgcttatttcattacatttcttagataaccattgaccacacctccaaaacccattttacagaaatccagccagaatcatgagtctgaatacatgactgttcttaagattcctgcctacctggaggctctaatcctgtgctcttgtaccctggcctgtattgtagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430856 - DNA, 1284 bp, Homo sapiens
ctgatgtgcactctaggttagtaaccatttttgtgaaaaatttagagaaattctttgagcagcttccactgaaacactaaaacccaatagggccaaaggcccaaaacctgaggaaaccttatttattgcttaatccaacataggctatgaaagttttgagtttcctcttgtgtattagaatttcattcctatttgttgtagagagtatagtacggggaatcagtaaattaaatgaagtaaactaaagattacaccttttctgctggcactaagcgaaaagcaaaaccagtggctgtctattatctcctgtgttttagacagtcaagtgttgagcacttgctcttattcctttattctctaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 430857 - DNA, 1519 bp, Homo sapiens
ggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccatagactttttcatagtaccctgtctggaatttgaaaggctggagtgactcaaaaactgaaaacagctgttgagccaagttttgaaggatttcaagtacaggaggaggagcaaccctcatatttggaataaagcatggttattttaggggcagagaagagggagcaaagaggagacaagaaatccttaggagactgctgtcaagtgtcccccacaaaaatactccattg

SEQ ID NO: 430858 - DNA, 474 bp, Homo sapiens
agtcacatgaccaagtgttgatttttctggaggaaaaattttatggaaatgatataggggaaaggtgggaggagatgaaagaacaggcaagagctgtcagggttaaatccaggtggcccagggctagctggctctaacaactagcatgacagcctccaatcagaaaggcaggtaaggggacagggtgaggagaatgggcagatactgacagaaattaaagtaaagggattgtgaaagtaaagagctcttcctgattctcatcttctcttttttctattacaaggcattgaacttggcacttcctgtattctttgtgatcactattgagtgcattagttaacacccaaggggatggcttgattgggaatgtagtgaaaggagctgatctactgtattgtaatgtaaaacagctacagccagttattttgtaagattataagttgttcattaaaaaatcagcacacaaaatatgaa

SEQ ID NO: 430859 - DNA, 1993 bp, Homo sapiens
agtcacatgaccaagtgttgatttttctggaggaaaaattttatggaaatgatataggggaaaggtgggaggagatgaaagaacaggcaagagctgtcagggttaaatccaggcccgggcatgagaatggaagtgatcagggagactcggtccttgttccaagtctccaaagaagaccaaagtgggtcccttgagcaatgaagaatctgagataaattctcttcaagtatcatgtacaaaatctgtgagccagagattttgacttgagcaagccatggaaatgcatggagcaagggtgacactctgtggggagacagaagaatttcaactatttaatgtccattttgttgtttttaccctttcttatccaatagatggaatgcacatgaaatgaccatattaagcctctctctatttacatcccaggctcactgggatgtggtctactgcagttacattttcttgtaacggtttctggattagaccctagggaaagtgagtaaggagccagtttctgtttaacattctagttttactcattttaggaaggctgtgagtgaggcttgtctcctttaaagtttcttctccaatggaaaccaagaacagacaaaatttagagctcagctgtggtctcttctcatcttctgctcttttgctttgaccacagtttttctactcttcccatcaacactagagcaatggctgtgcaaataggaataggaaatactaccacaatgatagaaatattatccacactatcacgtagggaagaacaatatcctgaaagagaataaaacacgaataaggtgatgtacccacattaatctgtgggtttgtggaatgagggttgcaaagttattgggaaaaggaaagagcagagttcacccattcaaaaaaaaccttttgtctactaatctctagtgtaaagaaaatgtagttcagataccattcattgtcttgggtcatgcttagtgcccccaagaagacaaacatatttattcttgggattctgataggcttcaatatgcaaaggacaatggaaaagtttagacactctattttcaaaattttataaacttgttttattggggaaaatgtccaaattgctagacacattctaagttctgccttggagaatcctactttgtctgagattgaggcagaggaattgttatcctgggcattactcagctcaggaacatggagcctgtggttcatgccagtgtgtgtcttcatgcagtctctccacaagagcaacagtaagaacatttctgttttaaatttcattttaaaatattttattatctgcaattcaccactgctctgggaaagcaaaaggaaagttcctgttgtgtgtgaagagcctcttaggctataaggcttcccagccatagtcagctatagctattcagagacagcaggttcttccagtctttgttcctgggacctgatgttttgagcaactcaggtcactgataaagtggaaggactaagacactgtggtcacagatcccagcaacatcaactcacactcaatccatgtggtggtccacattctgctactcttatccacccatgtggtcattgagagcctttctcagagactcttctgtgtgtttgattgtgcccaggtggcccagggctagctggctctaacaactagcatgacagcctccaatcagaaaggcaggtaaggggacagggtgaggagaatgggcagatactgacagaaattaaagtaaagggattgtgaaagtaaagagctcttcctgattctcatcttctcttttttctattacaaggcattgaacttggcacttcctgtattctttgtgatcactattgagtgcattagttaacacccaaggggatggcttgattgggaatgtagtgaaaggagctgatctactgtattgtaatgtaaaacagctacagccagttattttgtaagattataagttgttcattaaaaaatcagcacacaaaatatgaa

SEQ ID NO: 430860 - DNA, 2445 bp, Homo sapiens
agtcacatgaccaagtgttgatttttctggaggaaaaattttatggaaatgatataggggaaaggtgggaggagatgaaagaacaggcaagagctgtcagggttaaatccaggcccgggcatgagaatggaagtgatcagggagactcggtccttgttccaagtctccaaagaagaccaaagtgggtcccttgagcaatgaagaatctgagataaattctcttcaagtatcatgtacaaaatctgtgagccagagattttgacttgagcaagccatggaaatgcatggagcaagggtgacactctgtggggagacagaagaatttcaactatttaatgtccattttgttgtttttaccctttcttatccaatagatggaatgcacatgaaatgaccatattaagcctctctctatttacatcccaggctcactgggatgtggtctactgcagttacattttcttgtaacggtttctggattagaccctagggaaagtgagtaaggagccagtttctgtttaacattctagttttactcattttaggaaggctgtgagtgaggcttgtctcctttaaagtttcttctccaatggaaaccaagaacagacaaaatttagagctcagctgtggtctcttctcatcttctgctcttttgctttgaccacagtttttctactcttcccatcaacactagagcaatggctgtgcaaataggaataggaaatactaccacaatgatagaaatattatccacactatcacgtagggaagaacaatatcctgaaagagaataaaacacgaataaggtgatgtacccacattaatctgtgggtttgtggaatgagggttgcaaagttattgggaaaaggaaagagcagagttcacccattcaaaaaaaaccttttgtctactaatctctagtgtaaagaaaatgtagttcagataccattcattgtcttgggtcatgcttagtgcccccaagaagacaaacatatttattcttgggattctgataggcttcaatatgcaaaggacaatggaaaagtttagacactctattttcaaaattttataaacttgttttattggggaaaatgtccaaattgctagacacattctaagttctgccttggagaatcctactttgtctgagattgaggcagaggaattgttatcctgggcattactcagctcaggaacatggagcctgtggttcatgccagtgtgtgtcttcatgcagtctctccacaagagcaacagtaagaacatttctgttttaaatttcattttaaaatattttattatctgcaattcaccactgctctgggaaagcaaaaggaaagttcctgttgtgtgtgaagagcctcttaggctataaggcttcccagccatagtcagctatagctattcagagacagcaggttcttccagtctttgttcctgggacctgatgttttgagcaactcaggtcactgataaagtggaaggactaagacactgtggtcacagatcccagcaacatcaactcacactcaatccatgtggtggtccacattctgctactcttatccacccatgtggtcattgagagcctttctcagagactcttctgtgtgtttgattgtgcccaggtggcccagggctagctggctctaacaactagcatgacagcctccaatcagaaaggcaggtaaggggacagggtgaggagaatgggcagatactgacagaaattaaagtaaagggattgtgaaagtaaagagctcttcctgattctcatcttctcttttttctattacaaggcattgaacttggcacttcctgtattctttgtgatcactattgagtgcattagttaacacccaaggggatggcttgattgggaatgtagtgaaaggagctgatctactgtattgtaatgtaaaacagctacagccagttattttgtaagattataagttgttcattaaaaaatcagcacacaaaatatgaaaaaaaaaaaaaaaaaaaaaaaaaaccaaaaaacacaaaaaacaacaaaaacaaaaaacaaaaaaccaaaaaaaaaaggagagaaagaaaaaaaaaaaaaaaaaaaaaaaagtgggagggcagccgcagcctgctaaacaaaacgtccatcacacacttgtggggggcggcgcacccgccaatggacgagcaatggtaatacgcgaagaaaagaggaaaagagtgacacaacaacacacccagggtgggggtgggctcataaccacacaaacagaacgaaagcgaccgggcgggtaaagaaaaagaagagtggtgccgaacacaacaagtcaccacacgagagggtctgctagacgagatcagtacagggagctcatacctgcacacaacggccaggcgactaggcgagagagcagaaagtatgaacaacggcgacaggggaggtgggggtga

SEQ ID NO: 430861 - DNA, 3141 bp, Homo sapiens
  misc_feature (2986)..(2986): n is a, c, g, or t
cgcgcgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaacttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataatatttcatcatttggatatataataatttatttaaccagtctctttatttttatttatttattttgtttgttttctttgagatggagtctcgctctgtcacccaggctggagtacaatagcgtgatctcggctcactgcaacctccacctcctgggttcaagcagttctccngcctcagcctcctgagtactgggcacggtgttgtacctctagtcccagctacttgggaggcttagtcaggaggatctcttgagcctgggaggtcaaggctgcagtgaaccatgattgcactccaacctgggcgacagagaccctgtctcaaaaaa

SEQ ID NO: 430862 - DNA, 1218 bp, Homo sapiens
cgcgcgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagatt

SEQ ID NO: 430863 - DNA, 452 bp, Homo sapiens
aaaaaaagtagataaaatattgtcaagactgacaaaaagaaataagctcatgaagtgagattatatgatgctgcctatttggattgagaggaaatgtgatattgtagttaaaaacatgggtttttaaaatctagtttgagtactggtcttatgcttactgggtgaacttgttcaaataatgtcaagttttggaacctcatttataaagtggggctattaaaagtcccttcccgatggagttatggaattcagtgagatataatgcatgtaaagtacttagcatggtgccttatatattatcagcatgtagtacatgttaactgttttatttctttttatttttttggagacagggtatcaccctgtctcccaggccgggaggcggagcttgcagtgagccgagatcgcaccactgcactccagcctgggcgacagagcgagactccgtctca

SEQ ID NO: 430864 - DNA, 2815 bp, Homo sapiens
cgcgcgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaacttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataat

SEQ ID NO: 430865 - DNA, 2998 bp, Homo sapiens
cgcgcgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaaggagagatgaggctttgccatgttggccaggctggtcttgaactcctgacctcaagtgatccgctcgtctcagcctcccaaagtgctaggattacaggcgtgagccaccgcgcccggcccatattaactgttatcacgagtgttcagttttcatatttatgctcacttgctggtccgcctgcagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaacttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataat

SEQ ID NO: 430866 - DNA, 2587 bp, Homo sapiens
aaaaaaagtagataaaatattgtcaagactgacaaaaagaaataagctcatgaagtgagattatatgatgctgcctatttggattgagaggaaatgtgatattgtagttaaaaacatgggtttttaaaatctagtttgagtagctggtcttgaactcctgacctcaagtgatccgctcgtctcagcctcccaaagtgctaggattacaggcgtgagccaccgcgcccggcccatattaactgttatcacgagtgttcagttttcatatttatgctcacttgctggtccgcctgcagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaacttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataat

SEQ ID NO: 430867 - DNA, 675 bp, Homo sapiens
cgcgcgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagaaatcttgggcaattctgtaagaagagaattgaagtaactgagaggaattttagggcacaggtttgctgaagactgtgctgaaaccacctttacagggaaatgatcttttaatttatttccacatctttctctattaaaaaaaaatcaatg

SEQ ID NO: 430868 - DNA, 730 bp, Homo sapiens
  misc_feature (432)..(432): n is a, c, g, or t
ctctacagaacggaaatgaacttcattcacccccaaacccacccacttaaatccaaagagagcttagggttattatgcatggacaggaacacattctaccaagaacacatgctcttaagagctagtagctcccagttagagtcaaaccagtcattgttatattatagattgaatccagcctctttctcccaaactgtggtcatcactgcatgaatccacactaaggtgtgtgaatgggaacctgcagattatctcctcctactgaaaatgctgcccaggggaatcttggaagctatggacagcatccaggcagagctggtcccactgttatctccagaagcaaatgcccaagctgtgctcagaactggaagcaatggatgaggatagacatagacactcctgtgtctcaaacatgcttctttattactctgntatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacaagaggtgcagactgtgttggtggcggtaattttgtccatcaaatgaatatgtgtgcaatcttcaggatttgcctactggccctacctct

SEQ ID NO: 430869 - DNA, 3265 bp, Homo sapiens
ctctacagaacggaaatgaacttcattcacccccaaacccacccacttaaatccaaagagagcttagggttattatgcatggacaggaacacattctaccaagaacacatgctcttaagagctagtagctcccagttagagtcaaaccagtcattgttatattatagattgaatccagcctctttctcccaaactgtggtcatcactgcatgaatccacactaaggtgtgtgaatgggaacctgcagattatctcctcctactgaaaatgctgcccaggggaatcttggaagctatggacagcatccaggcagagctggtcccactgttatctccagaagcaaatgcccaagctgtgctcagaactggaagcaatggatgacttgtatcaggtgcttgtttgagaggatatattgacattattgccatagtaagcttaaaaaaatgtgcccactcattcattctttgtccatggaccactaatcatgcattgtcatttccaaagataaggggaaacatatcacatatcattgaaatagaaattagggaaagtttgtcaatttgttttcactataaggcatcaatggcagaaactacatatgagtaattttcaaaatagaccattgcttaaatgtttaaatgaagctaaaacaagtatgaacccattggttagagtgcagtggcttctttcaggcagacagcagatgctctcagatttggtggtgagttttggccttggcatggttggcatggagtcagcacaggaagccgggaggtatgaaggggcatccacctgggtgaaactgtcttgccaagccaaagccccgaggcctgccctgaagcagctgtagtggaggagaggcctgggattccttagagtcacctttttacgaatgtaccgccactctgttagctcacaaggaaaataaggaaaagccaggcctcccacctcttgactcttgtgagagtgaagacaacatggggcatttagaaaatatatttttagtgtatgataatgtgggctggcccacacagcaatgagcccaaagaccccctcgctttgggaattattcatggccctgctcatcacagcctctgatatgcatgactgtaacctaggctgagccaagaatggagctcatgccagaaatggtcctaagcatgcacatggccccctggaatatcaaaatcctggggagaaagaaatcatctttgccttgggcagtgaagctggaatggcacatatctatctgttgccacatctcctgcctagtggagaagccttggaaggcaacagacactgagcaagcagcagggaggagaatgtcctggaagggcaggactctacccaagtccctaacatccccagactcttctcttccataaactctctaattactctgctgtttaaatcctggttttggtcaagccagtcaggttgcataaagaatatgaatacagtatgcatcaaagttgcttcccagaacaggaagcaaaacaaacaaacaaacaaacaaaatactgatatcagtacccagggtgcccaattaggtcacacccagtggctgcattgcagcccctgagctcctgctgcaccgtgtgtcctgctgcccgagtgggccccaccctgggttctgaagatgcccttcttaatggagagctcccgatggagggctccaggactgatgctctccctaaggaagggaggcctcagatttggagagggacaccaacaggaccagaggaggactgaggggcactggcaccaataagtggaagggaacagcgtggtaacaaaaaagagccatgccacttgcatgctggagggagtctttttgtgtcagcctaaagcttaggctggtgtccatgtggaacatgacatctttccagtatccctgatccaggaaactgcagtgagacccaggtgacccagctctgtgtcatttggagcccattaaaaagtgaggcagccacatggcggggacattgaccccactccagaccacactcccatctccatacataggatagaaactgttcatcaggaaggaaaaccaaacagaaatttgtggtctaggggaggggtctgcattcagcatggccatgctgggctggagtggctgtggggtgtccagatagatgggcatgtagactagtgctttctcaacctttaatgcatgcacaaatcatcgagatcttgttaaaatgtagatcctgggtgggcacggtggctcacgcctgtaatcccagcactttgggaggctgaggcgggcggatcatgaggtcaggagatcgagaccatcctggctaacacggtgaaaccctgtctctactaaaaatacaaaaaattagccaggcatggtggtgggtgcctgtagtcccagctactcgggaggctgaggcaggagaatggcatgaacccgggaggcggagcttgcagtgagccgagatcgtgctgctgcactccagcctgggcaatagagtgagattccgtctcaaaaaaaaaaaaaaaaaaatgtagatcctggctcaggaggtctgggataggacctgggattctgagtttctaacaagctcccagggatgtccatgcttctggtccctgaaccacactttgagtgacaaggatgtaaactgttggaaacatggatctggtgctcattgcgggaaagggggtgtcctcagggcataggtcacagccaaagccctgacagcgggcaagagtcccagggagaggctgcctgcacattgaggaggggaagggctgggcctgagcagtggggagcatccatgctggcaggtatgcagcaggcaaggagatccaggtggagatcagaggacagtgacagtcacagcagcaggggagagccaggagaaagctgctcctaggggtgtctcaaaggaagaagggctctgcagtgtgaactctgcagagggcagggagaatagaggttaagcctttgctcattctgaattaattgattactgctttttaaaagtgctttctttctctgggaaaaaaaacattccccagtgcctaaggctaacagacgtgggcgctgagctgtgtctggtctgctgagtgtattttccacagagcaatcctcatcttctcagggggtggggatttggacaagactcttcctgaacacgcagcgtggtggggaagggtggccatggaggttttctgttccttctgttgtcactggtgaaagacgacttggtgcccaatttctaataaacacaatgctattagcgtcactcca

SEQ ID NO: 430870 - DNA, 3389 bp, Homo sapiens
ctctacagaacggaaatgaacttcattcacccccaaacccacccacttaaatccaaagagagcttagggttattatgcatggacaggaacacattctaccaagaacacatgctcttaagagctagtagctcccagttagagtcaaaccagtcattgttatattatagattgaatccagcctctttctcccaaactgtggtcatcactgcatgaatccacactaaggtgtgtgaatgggaacctgcagattatctcctcctactgaaaatgctgcccaggggaatcttggaagctatggacagcatccaggcagagctggtcccactgttatctccagaagcaaatgcccaagctgtgctcagaactggaagcaatggatgacttgtatcaggtgcttgtttgagaggatatattgacattattgccatagtaagcttaaaaaaatgtgcccactcattcattctttgtccatggaccactaatcatgcattgtcatttccaaagataaggggaaacatatcacatatcattgaaatagaaattagggaaagtttgtcaatttgttttcactataaggcatcaatggcagaaactacatatgagtaattttcaaaatagaccattgcttaaatgtttaaatgaagctaaaacaagtatgaacccattggttagagtgcagtggcttctttcaggcagacagcagatgctctcagatttggtggtgagttttggccttggcatggttggcatggagtcagcacaggaagccgggaggtatgaaggggcatccacctgggtgaaactgtcttgccaagccaaagccccgaggcctgccctgaagcagctgtagtggaggagaggcctgggattccttagagtcacctttttacgaatgtaccgccactctgttagctcacaaggaaaataaggaaaagccaggcctcccacctcttgactcttgtgagagtgaagacaacatggggcatttagaaaatatatttttagtgtatgataatgtgggctggcccacacagcaatgagcccaaagaccccctcgctttgggaattattcatggccctgctcatcacagcctctgatatgcatgactgtaacctaggctgagccaagaatggagctcatgccagaaatggtcctaagcatgcacatggccccctggaatatcaaaatcctggggagaaagaaatcatctttgccttgggcagtgaagctggaatggcacatatctatctgttgccacatctcctgcctagtggagaagccttggaaggcaacagacactgagcaagcagcagggaggagaatgtcctggaagggcaggactctacccaagtccctaacatccccagactcttctcttccataaactctctaattactctgctgtttaaatcctggttttggtcaagccagtcaggttgcataaagaatatgaatacagtatgcatcaaagttgcttcccagaacaggaagcaaaacaaacaaacaaacaaacaaaatactgatatcagtacccagggtgcccaattaggtcacacccagtggctgcattgcagcccctgagctcctgctgcaccgtgtgtcctgctgcccgagtgggccccaccctgggttctgaagatgcccttcttaatggagagctcccgatggagggctccaggactgatgctctccctaaggaagggaggcctcagatttggagagggacaccaacaggaccagaggaggactgaggggcactggcaccaataagtggaagggaacagcgtggtaacaaaaaagagccatgccacttgcatgctggagggagtctttttgtgtcagcctaaagcttaggctggtgtccatgtggaacatgacatctttccagtatccctgatccaggaaactgcagtgagacccaggtgacccagctctgtgtcatttggagcccattaaaaagtgaggcagccacatggcggggacattgaccccactccagaccacactcccatctccatacataggatagaaactgttcatcaggaaggaaaaccaaacagaaatttgtggtctaggggaggggtctgcattcagcatggccatgctgggctggagtggctgtggggtgtccagatagatgggcatgtagactagtgctttctcaacctttaatgcatgcacaaatcatcgagatcttgttaaaatgtagatcctgggtgggcacggtggctcacgcctgtaatcccagcactttgggaggctgaggcgggcggatcatgaggtcaggagatcgagaccatcctggctaacacggtgaaaccctgtctctactaaaaatacaaaaaattagccaggcatggtggtgggtgcctgtagtcccagctactcgggaggctgaggcaggagaatggcatgaacccgggaggcggagcttgcagtgagccgagatcgtgctgctgcactccagcctgggcaatagagtgagattccgtctcaaaaaaaaaaaaaaaaaaatgtagatcctggctcaggaggtctgggataggacctgggattctgagtttctaacaagctcccagggatgtccatgcttctggtccctgaaccacactttgagtgacaaggatgtaaactgttggaaacatggatctggtgctcattgcgggaaagggggtgtcctcagggcataggtcacagccaaagccctgacagcgggcaagagtcccagggagaggctgcctgcacattgaggaggggaagggctgggcctgagcagtggggagcatccatgctggcaggtatgcagcaggcaaggagatccaggtggagatcagaggacagtgacagtcacagcagcaggggagagccaggagaaagctgctcctaggggtgtctcaaaggaagaagggctctgcagtgtgaactctgcagagggcagggagaatagaggttaagcctttgctcattctgaattaattgattactgctttttaaaagtgctttctttctctgggaaaaaaaacattccccagtgcctaaggctaacagacgtgggcgctgagctgtgtctggtctgctgagtgtattttccacagagcaatcctcatcttctcagggggtggggatttggacaagactcttcctgaacacgcagcgtggtggggaagggtggccatggaggttttctgttccttctgttgtcactggtgaaagacgacttggtgcccaatttctaataaacacaatgctattagcgtcactccaatttagtgtctgattgttaaatgttaatgtactgcactctacagttttaaatataattagagatgtttacagctttggttaaatgcaccttgttcttccacattaaactttattacaagcgtcc

SEQ ID NO: 430871 - DNA, 1008 bp, Homo sapiens
gcggccgcgggcgccgccgcctcctcctccatggctgtttacccggctgcattgtgggagtttgacctccgccgccgccaaccgccgcctcagcttgcgccgccgccgccgccgccgccgccgcgcacgccatgggagccgtgactgacgacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 430872 - DNA, 890 bp, Homo sapiens
gcggccgcgggcgccgccgcctcctcctccatggctgtttacccggctgcattgtgggagtttgacctccgccgccgccaaccgccgcctcagcttgcgccgccgccgccgccgccgccgccgcgcacgccatgggagccgtgactgacgatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 430873 - DNA, 931 bp, Homo sapiens
agcggaactgccgcctcagcttgcgccgccgccgccgccgccgccgcgcacgccatgggagccgtgactgacgacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 430874 - DNA, 1042 bp, Homo sapiens
gcggccgcgggcgccgccgcctcctcctccatggctgtttacccggctgcattgtgggagtttgacctccgccgccgccaaccgccgcctcagcttgcgccgccgccgccgccgccgccgccgcgcacgccatgggagccgtgactgacgacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgcaatctgaaacttctccaactaggggtcacgactcg

SEQ ID NO: 430875 - DNA, 1204 bp, Homo sapiens
gcggccgcgggcgccgccgcctcctcctccatggctgtttacccggctgcattgtgggagtttgacctccgccgccgccaaccgccgcctcagcttgcgccgccgccgccgccgccgccgccgcgcacgccatgggagccgtgactgacgacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatgttcggcgtgtgcagtatggtcgttcggcgtgtgcagtctggatgttcggcgtgtgcagtctggttattcggcgtgtgcatgcacacgccgagggtccatacacagaaagagagagagagagagagagagagagagagaggaaggacggggaaagagagaacagaagggaggactggtcgaagggccagtggagcaggtgtcttggagagacaggccatgaacttgcaaggggtctgaggggagccgcagagtcggtgagggttgaaagtctgtaaatgc

SEQ ID NO: 430876 - DNA, 1141 bp, Homo sapiens
agcgggtgactgacggtgaggccccgctcgccgccacacgcgcccgctgcacggcccgctgggcctcccctgagacccctggcctcccggcccgcttccgggaacccctcggcctccccggcctcttcgccagagcgcttcggccttcccgacctctccccggagccccgggcctccccggctgcttccctgagtccttcctcctctcgccagagcccgagcgcccctcggagaccctcggctttccccgtccgctctcccggaggcagcgcggggctataggacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 430877 - DNA, 942 bp, Homo sapiens
cgcggccgcccccggggagtaccgggagcgcggggagcgcgggtcccgccgccgccgcgcacgccatgggagccgtgactgacgacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 430878 - DNA, 914 bp, Homo sapiens
ggaccccgactgcgggcggcccgcagctcccgccgcacccccgcagccctggcggcacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 430879 - DNA, 919 bp, Homo sapiens
gcggccgcgggcgccgccgcctcctcctccatggctgtttacccggctgcattgtgggagtttgacctccgccgccgccaaccgccgcctcagcttgcgccgccgccgccgccgccgccgccgcgcacgccatgggagccgtgactgacgacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatacttggactctgggcactgtttggactctgggcactgtttggactctgggcactgtttgtactctg

SEQ ID NO: 430880 - DNA, 1114 bp, Homo sapiens
agcgggtgactgacggtgaggccccgctcgccgccacacgcgcccgctgcacggcccgctgggcctcccctgagacccctggcctcccggcccgcttccgggaacccctcggcctccccggcctcttcgccagagcgcttcggccttcccgacctctccccggagccccgggcctccccggctgcttccctgagtccttcctcctctcgccagagcccgagcgcccctcggagaccctcggctttccccgtccgctctcccggaggcagcgcggggctataggacgaagttatacggaagcgtctcctcattgatggagatggtgctggagatgatcggagaattaatctgctagtgaagagtttcattaaatgatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 430881 - DNA, 715 bp, Homo sapiens
gagatgaggtgatcagaatggagagtgtagggtaataggtgtaagtaacatttggaggctatcaggtggtaagagtgacagcttttttacttgggtgactgagttgatggtgatttatttagcaggataaagaatacaggggcaacatagggaaaccccatctctaccaaaaatacaaaaattagccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 430882 - DNA, 2223 bp, Homo sapiens
gtcacagcctggtgaggagggggctgcagttcctcaggaaactgccagtggacaaattcataaacaagagctccagttccctggaacctgagtcgggagacctgcagctcactttctccctgtttgctggccagcagggtttgtggccgcctctgctgtgacgccacagcctggtgaggagggggctgcagttcctcaggaaactgccagtggacaaagtcataaacaagagttccagttccctggaacctgagtcgggaggcctgcaactcactttctccctgtttgctggcccagacaggcctgtgctagagggctggatagtgtggtagtgtggtggatagagtgctgcctctatccacaacgcagccatatgctgactgaagataactttgtgtctggaagagccctctgatttcttacactaatggccttacacgacatggaggattttacatttgatggaacaaagcgcttaagtgtcaactacgtgaagggaattcttcaaccgacagacacctgtgacatctgggataagatctggaacttccaagccaagcctgatgacctgcttatttctacctatcctaaagcaggaacaacatggactcaggagatagtggaattaatacaaaatgaaggtgatgtggagaaaagtaaacgggcaccgactcatcaacgatttcctttcctcgaaatgaaaatcccatccttaggatctggtttggaacaagctcatgcaatgccctcaccacggatcctgaaaacacatcttccctttcacttgctgccaccatccttgctagagaaaaactgtaagataatctatgtagcaagaaatcccaaggacaacatggtgtcctattaccatttccaaagaatgaataaagctcttcctgctccaggaacatgggaagagtattttgagacttttctggctgggaaagtgtgctggggctcctggcatgaacatgtgaaaggatggtgggaagccaaagacaaacaccgtattctctatctcttctatgaggacatgaagaagaacccaaagcatgaaattcagaagctggcagaatttattgggaagaaattagatgacaaagttctagataaaattgtccattacacttcgtttgatgtcatgaaacagaatccaatggcaaactattcatcgattcctgctgaaatcatggaccactccatttctccattcatgagaaaaggggcagtgggagactggaagaaacacttcaccgtggctcagaatgagagatttgatgaagattacaagaagaaaatgactgataccagactaactttccacttccagttctagtaaggaagaaaaactgaaaatgttttagtttattacccagtatatttgggtaataatgaaagtttaattctcataacaaatgatatcagattccagttatcagaatagtttactgtgtttgctcttattcactctactaaaaaattattttaaaaggctggaggcaaggtggtgacaggcagcagggtggcgacatggagagagggaagctcaataaatcactaggtacaatcctggtatcattgccaattatcatcatatttacattttctacaatcatgtgcttattaacatattggaaatgcttcagtcctcacatgataatacactaacattttcagattaagttttggttcaagttaatttttttttttttttttttgagacggagtctcgctctgtcgcccaggctggagtgcagtggcacgatctcggctcactgcaagctctgcttcctgggttcacgccattcccctgcctcagcctcccgagtagctgggactatgggcgcccaccaccactcccggctaatttttttttttgtattcttagtagagacgaggtttcaccgtgttagccaggatgttctcgatctcctgaccccatgatccacccgcctcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaattaaaaaaaaaatgacttcttgtccagtgc

SEQ ID NO: 430883 - DNA, 876 bp, Homo sapiens
gtcacagcctggtgaggagggggctgcagttcctcaggaaactgccagtggacaaattcataaacaagagctccagttccctggaacctgagtcgggagacctgcagctcactttctccctgtttgctggccagcagggtttgtggccgcctctgctgtgacgccacagcctggtgaggagggggctgcagttcctcaggaaactgccagtggacaaagtcataaacaagagttccagttccctggaacctgagtcgggaggcctgcaactcactttctccctgtttgctggcccagacaggcctgtgctagagggctggatagtgtggtagtgtggtggatagagtgctgcctctatccacaacgcagccatatgctgactgaagataactttgtgtctggaagagccctctgatttcttacactaatggccttacacgacatggaggattttacatttgatggaacaaagcgcttaagtgtcaactacgtgaagggaattcttcaaccgacagacacctgtgacatctgggataagatctggaacttccaagccaagcctgatgacctgcttatttctacctatcctaaagcaggaacaacatggactcaggagatagtggaattaatacaaaatgaaggtgatgtggagaaaagtaaacgggcaccgactcatcaacgatttcctttcctcgaaatgaaaatcccatccttaggatctggtgagtataaatagccacacttcactacagtcctaaaatgcacttaggatttttactgtctttgcacctttcgaaattataggctttcaaacaattattggtaagtttcatggttttgtctttttttaactgtgtctggccattgttatactcc

SEQ ID NO: 430884 - DNA, 1444 bp, Homo sapiens
gtcacagcctggtgaggagggggctgcagttcctcaggaaactgccagtggacaaattcataaacaagagctccagttccctggaacctgagtcgggagacctgcagctcactttctccctgtttgctggccagcagggtttgtggccgcctctgctgtgacgccacagcctggtgaggagggggctgcagttcctcaggaaactgccagtggacaaagtcataaacaagagttccagttccctggaacctgagtcgggaggcctgcaactcactttctccctgtttgctggcccagacaggcctgtgctagagggctggatagtgtggtagtgtggtggatagagtgctgcctctatccacaacgcagccatatgctgactgaagataactttgtgtctggaagagccctctgatttcttacactaatggccttacacgacatggaggattttacatttgatggaacaaagcgcttaagtgtcaactacgtgaagggaattcttcaaccgacagacacctgtgacatctgggataagatctggaacttccaagccaagcctgatgacctgcttatttctacctatcctaaagcaggaacaacatggactcaggagatagtggaattaatacaaaatgaaggtgatgtggagaaaagtaaacgggcaccgactcatcaacgatttcctttcctcgaaatgaaaatcccatccttaggatctgtgtgctggggctcctggcatgaacatgtgaaaggatggtgggaagccaaagacaaacaccgtattctctatctcttctatgaggacatgaagaagaacccaaagcatgaaattcagaagctggcagaatttattgggaagaaattagatgacaaagttctagataaaattgtccattacacttcgtttgatgtcatgaaacagaatccaatggcaaactattcatcgattcctgctgaaatcatggaccactccatttctccattcatgagaaaaggggcagtgggagactggaagaaacacttcaccgtggctcagaatgagagatttgatgaagattacaagaagaaaatgactgataccagactaactttccacttccagttctagtaaggaagaaaaactgaaaatgttttagtttattacccagtatatttgggtaataatgaaagtttaattctcataacaaatgatatcagattccagttatcagaatagtttactgtgtttgctcttattcactctactaaaaaattattttaaaaggctggaggcaaggtggtgacaggcagcctgggtgacagagcaagactccatctcaaaaaaaaaaaaaaaaaaaaaagtctcccataaccaggatgacaagaatgcagcctcagaaaaaatgaactgtatgaaatgtatctaccctaacatgacttgcctgggcagtaacagcaaaaa

SEQ ID NO: 430885 - DNA, 330 bp, Homo sapiens
acccaaagcatgaaattcagaagctggcagaatttattgggaagaaattagatgacaaagttctagataaaattgtccattacacttcgtttgatgtcatgaaacagaatccaatggcaaactattcatcgattcctgctgaaatcatggaccactccatttctccattcatgagaaaaggtttttatagtttattttcattataatcttaaaagaactgtcaaatattttaaagcatttgaggagttttctttcctgtgtctaggaaaaataatatctgtaataaatgatttggggaaaagaagtatttaagaagccactgataaaatg

SEQ ID NO: 430886 - DNA, 2883 bp, Homo sapiens
tggaggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgttggaattccccctcaaaatgtataacaaatctgtttacttcccttcacctgcacagcttaccacccttgtataagatattgtctgttgccaagaatcttgcaccagactagtggttctcaaagtgtgatccctggacccgcagcatctgcagcacctgggaaataataagaaatacaaattctgaaatattgaatcagaaactctgaaggtggaggccagcaatttgtgttttaataagccctcctgtgattctgatgcattcctgaagactaacatgccttctgcttcatttttgtctcagatcacactatcttacaaatgaaaactttccaatgggccgggagcagaggctcgtgcctgtaatcccagcaattcgggaggctgaggcgggtggatcacttgaagccaagagtttgagaccaatctggtcagcatggcaaaacctgtctctgctaaaaacaaaaaacaaaaactagctgggtgtgatggcacacacctgtagtcccagctactcagggggctgaggcaggagaattgcttgagcctgggaggcggaggttgcagtgagccgagatcgcatcagtgcattccatcctgggcgacagagtgagaccctgtctc

SEQ ID NO: 430887 - DNA, 3729 bp, Homo sapiens
tttcaagtgaaaggtttttatttttttaaactaagtaaatttctttttctcccaatttactcactgcagtaccttatactacaagaaccagcaactggtttcctcttaatgtctaaacataacatcattgttaaaaattagagactttgtcacaatttgcagtttttaaaagtaaggtaaataaagtatctcattatacagaagtacaaggtctcgttcttgtacatttcgctcttcccaaatattctgcaatcagaaccctgattgcaaaactaagcacatggattctcaaaagacaccaggccagagaattctttcatcctagtcccaatctcgcccttgaaagcgtgggaggggcaaggctgcgccacgggaaataaatgagggctgccaaaggccgtcggaggccgcggggctcggcaggcaggcgaagacccagcgtcgcattgcagagtcgagacgacctgggctgccgtgacgccgcagtcgccggccctagtttcccccgccctgcccgagcgcgtccgcgcctctcgcccgaatccgggtaccaccggcgactcgggtcggccccttctggcttgttccggcgtccggcctggcatgcgggtgctgcggctgctgcggctgccgccgccgctgctgccgctgccgcgggggctgcggcttgggaagctccgcgcttccgcaggcctggcctccgccgcccgggcccccgcagcctgtcgctggaccccgcgccggcccagcgcaccgccctcaggccccgagccccgccctggcctccgcctcggcctcgcctccagccccgggacgcggcccgccaccgccgctgccgccagcccagacgcgccgcccgcatgcgccgcgaccatggagcgccccgaagcgggaggaattaattccaatgagtgtgaaaatgtatcaagaaaaaagaaaatgtcagaggaatttgaagccaatactatggattctctggtagacatgccatttgctactgtagatattcaggatgactgtggaatcactgatgaacctcaaataaatttgaagagaagtcaagaaaatgaatgggtcaagagtgatcaagtaaagaagaggaaaaaaaagagaaaagattatcaacccaactatttcctgtccattccaatcaccaacaaagagattataaaaggaattaagatcctgcagaatgcaataatacaacaagatgagcgactggccaaagcaatggtcagtgatggttcctttcatattaccctgctggtgatgcaattattaaatgaagatgaagtaaacattggtattgatgctcttttggaattgaaaccattcatagaagaactcctccagggaaaacatttgactttgccctttcaagggattggtacttttggaaatcaggttggatttgtgaagctggcagaaggagatcatgtaaactcacttttggagatagcagagactgcaaataggacatttcaagaaaaaggcatcctggtaggagagagcagaagttttaaacctcatttgaccttcatgaagttgtcaaaatcaccgtggctccgtaagaatggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 430888 - DNA, 3369 bp, Homo sapiens
tgcgcttcccagcacagctcaatgctaactgcggaagcgggctgtgaacatggtccggtttccccggatgcacttcttcatgcccggctttgccccattgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaccggctgtctgtgacatcccacctcgggggctaaaaatgtccgccaccttcattggcaacagcacggccatccaggagctgttcaagcgcatctccgcctcggcctcgcctccagccccgggacgcggcccgccaccgccgctgccgccagcccagacgcgccgcccgcatgcgccgcgaccatggagcgccccgaagcgggaggaattaattccaatgagtgtgaaaatgtatcaagaaaaaagaaaatgtcagaggaatttgaagccaatactatggattctctggtagacatgccatttgctactgtagatattcaggatgactgtggaatcactgatgaacctcaaataaatttgaagagaagtcaagaaaatgaatgggtcaagagtgatcaagtaaagaagaggaaaaaaaagagaaaagattatcaacccaactatttcctgtccattccaatcaccaacaaagagattataaaaggaattaagatcctgcagaatgcaataatacaacaagatgagcgactggccaaagcaatggtcagtgatggttcctttcatattaccctgctggtgatgcaattattaaatgaagatgaagtaaacattggtattgatgctcttttggaattgaaaccattcatagaagaactcctccagggaaaacatttgactttgccctttcaagggattggtacttttggaaatcaggttggatttgtgaagctggcagaaggagatcatgtaaactcacttttggagatagcagagactgcaaataggacatttcaagaaaaaggcatcctggtaggagagagcagaagttttaaacctcatttgaccttcatgaagttgtcaaaatcaccgtggctccgtaagaatggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 430889 - DNA, 2747 bp, Homo sapiens
tttcaagtgaaaggtttttatttttttaaactaagtaaatttctttttctcccaatttactcactgcagtaccttatactacaagaaccagcaactggtttcctcttaatgtctaaacataacatcattgttaaaaattagagactttgtcacaatttgcagtttttaaaagtaaggtaaataaagtatctcattatacagaagtacaaggtctcgttcttgtacatttcgctcttcccaaatattctgcaatcagaaccctgattgcaaaactaagcacatggattctcaaaagacaccaggccagagaattctttcatcctagtcccaatctcgcccttgaaagcgtgggaggggcaaggctgcgccacgggaaataaatgagggctgccaaaggccgtcggaggccgcggggctcggcaggcaggcgaagacccagcgtcgcattgcagagtcgagacgacctgggctgccgtgacgccgcagtcgccggccctagtttcccccgccctgcccgagcgcgtccgcgcctctcgcccgaatccgggtaccaccggcgactcgggtcggccccttctggcttgttccggcgtccggcctggcatgcgggtgctgcggctgctgcggctgccgccgccgctgctgccgctgccgcgggggctgcggcttgggaagctccgcgcttccgcaggcctggcctccgccgcccgggcccccgcagcctgtcgctggaccccgcgccggcccagcgcaccgccctcaggccccgagccccgccctggcctccgcctcggcctcgcctccagccccgggacgcggcccgccaccgccgctgccgccagcccagacgcgccgcccgcatgcgccgcgaccatggagcgccccgaagcgggaggaattaattccaatgagtgtgaaaatgtatcaagaaaaaagaaaatgtcagaggaatttgaagccaatactatggattctctggtagacatgccatttgctactgtagatattcaggatgactgtggaatcactgatgaacctcaaataaatttgaagagaagtcaagaaaatgaatgggtcaagagtgatcaagtaaagaagaggaaaaaaaagagaaaagattatcaacccaactatttcctgtccattccaatcaccaacaaagagattataaaaggaattaagatcctgcagaatgcaataatacaacaagatgagcgactggccaaagcaatggtcagtgatggttcctttcatattaccctgctggtgatgcaattattaaatgaagatgaagtaaacattggtattgatgctcttttggaattgaaaccattcatagaagaactcctccagggaaaacatttgactttgccctttcaagggattggtacttttggaaatcaggttggatttgtgaagctggcagaaggagatcatgtaaactcacttttggagatagcagggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 430890 - DNA, 2995 bp, Homo sapiens
tttcaagtgaaaggtttttatttttttaaactaagtaaatttctttttctcccaatttactcactgcagtaccttatactacaagaaccagcaactggtttcctcttaatgtctaaacataacatcattgttaaaaattagagactttgtcacaatttgcagtttttaaaagtaaggtaaataaagtatctcattatacagaagtacaaggtctcgttcttgtacatttcgctcttcccaaatattctgcaatcagaaccctgattgcaaaactaagcacatggattctcaaaagacaccaggccagagaattctttcatcctagtcccaatctcgcccttgaaagcgtgggaggggcaaggctgcgccacgggaaataaatgagggctgccaaaggccgtcggaggccgcggggctcggcaggcaggcgaagacccagcgtcgcattgcagagtcgagacgacctgggctgccgtgacgccgcagtcgccggccctagtttcccccgccctgcccgagcgcgtccgcgcctctcgcccgaatccgggtaccaccggcgactcgggtcggccccttctggcttgttccggcgtccggcctggcatgcgggtgctgcggctgctgcggctgccgccgccgctgctgccgctgccgcgggggctgcggcttgggaagctccgcgcttccgcaggcctggcctccgccgcccgggcccccgcagcctgtcgctggaccccgcgccggcccagcgcaccgccctcaggccccgagccccgccctggcctccgcctcggcctcgcctccagccccgggacgcggcccgccaccgccgctgccgccagcccagacgcgccgcccgcatgcgccgcgaccatggagcgccccgaagcgggaggaattaattccaatgagtgtgaaaatgtatcaagaaaaaagaaaatgtcagaggaatttgaagccaatactatggattctctggtagacatgccatttgctactgtagatattcaggatgactgtggaatcactgatgaacctcaaataaatttgaagagaagtcaagaaaatgaatgggtcaagagtgatcaagtaaagaagaggaaaaaaaagagaaaagattatcaacccaactatttcctgtccattccaatcaccaacaaagagaggagcaggtgctgagagaggaagggagatggtggaccaggtctgtggggatttctcctggatgcagattctgtttttctaatgtgtgcatttggacttctttgcaactcttcatggtaatgcccctccccacagattataaaaggaattaagatcctgcagaatgcaataatacaacaagatgagcgactggccaaagcaatggtcagtgatggttcctttcatattaccctgctggtgatgcaattattaaatgaagatgaagtaaacattggtattgatgctcttttggaattgaaaccattcatagaagaactcctccagggaaaacatttgactttgccctttcaagggattggtacttttggaaatcaggttggatttgtgaagctggcagaaggagatcatgtaaactcacttttggagatagcagagactgcaaataggacatttcaagaaaaaggcatcctggtaggagagagcagaagttttaaacctcatttgaccttcatgaagttgtcaaaatcaccgtggctccgtaagaatggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 430891 - DNA, 1997 bp, Homo sapiens
tggaggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 430892 - DNA, 1357 bp, Homo sapiens
tcttcctgtcgctcttcaaggtttccaaaagaccatctttcagcagttgcctcaattaaggccttggaaccaggagtgaaaaaaatagatcctgatttatatgaaaagtttatcagtcacagatttggagaagaaatattatatcgcatagatctttgctccatgctgaagaaaaaacaaagtaatggttattatcactgtgaatcttccattgtgattggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 430893 - DNA, 2331 bp, Homo sapiens
tggaggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgagttggaaagctcgtcctctgcagtcctacagagatacagcaaggatatacccagttggtcaagtggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 430894 - DNA, 1393 bp, Homo sapiens
tggaggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 430895 - DNA, 1711 bp, Homo sapiens
tggaggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaagacttagccgacaggccctcccttttctccccaactctctcccgcgccttataa

SEQ ID NO: 430896 - DNA, 379 bp, Homo sapiens
aaaatgaatgggtcaagagtgatcaagtaaagaagaggaaaaaaaagagaaaagattatcaacccaactatttcctgtccattccaatcaccaacaaagaggtgctatttttaaaaagttatttttactgtgaaattttattctaaatttaaagtacaactaaatgcttattagcccacttgctcttagcttttaagagtatttggtggcattttagcaggactgtccagggaatatttctgtttaagtaatagaaatgtatttaaacaacaggtttggaaaatatcatttgtttttctgagacagggtcttgctctggcacccaggctggagtgcagtggcacagtcatagctcactgcagctttgaactcctggact

SEQ ID NO: 430897 - DNA, 467 bp, Homo sapiens
aacattgtggtgccgggagctgtgcttcagatcatgagtcagctcactatggccctcaggccaaatctggttaaccaccctgctttgaaaataaagcaggaacacaactgtacccactcatttatgttttgtctacagcagagttgagtagttaacggcagagactatgtcatctgcaatgcctaaactatttactatgaggtcctttacagaaatgtttgcaaactcctgctttagatttgaaaatgacactgatgaatgattgctacttatatattgcttgtttttttttctgactgtattatctttgtttaaatgtattagacgtattgtttgacttttttcctctagtcactgatgaacctcaaataaatttgaagagaagtcaagaaaatgaatgggtcaagagtgatcaagtaaagaagaggaaaaaaaagagaaaagattatcaacccaactatttcctg

SEQ ID NO: 430898 - DNA, 2038 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatgacattttacagtaaaggaattgattaaaaacagaaaaagttag

SEQ ID NO: 430899 - DNA, 1810 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430900 - DNA, 1909 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttc

SEQ ID NO: 430901 - DNA, 926 bp, Homo sapiens
gggctgttcacaggtcagccaacttctcagagtggccattttatagccatttggaaaccttgtagcttgtagttgttgcgtatttccaaataagtttgatagcatcttattaacattggttattttcattgtatcccaatttaatttgattatattcccatctacttttcaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430902 - DNA, 507 bp, Homo sapiens
ttaacataactttgtttattggtgggtttgtggtcaaaaaaaagagaaaaaaaaaagggctggtggggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430903 - DNA, 975 bp, Homo sapiens
gggctgttcacaggtcagccaacttctcagagtggccattttatagccatttggaaaccttgtagcttgtagttgttgcgtatttccaaataagtttgatagcatcttattaacattggttattttcattgtatcccaatttaatttgattatattcccatctacttttcaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatgacattttacagtaaaggaattgattaaaaacagaaaaagttag

SEQ ID NO: 430904 - DNA, 846 bp, Homo sapiens
gggctgttcacaggtcagccaacttctcagagtggccattttatagccatttggaaaccttgtagcttgtagttgttgcgtatttccaaataagtttgatagcatcttattaacattggttattttcattgtatcccaatttaatttgattatattcccatctacttttcaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttc

SEQ ID NO: 430905 - DNA, 1248 bp, Homo sapiens
tgtaagaagcttaatgaatacatataatcttgatggctgggcacggtaatcccagccctttgggatgccaaggtgggcggatcacttgaggctgagagtttgagacctgcctggccaacatggtgaaacctgtctctactaaaaatacaaaaattaactgggcatggtggtgcatgtcagtaatccctgctactcaggaggtggaggcacgagaatcacttgaacccaggaggtggaggttgcagtgagctaagattgtgccactgcactccaatctgggtgacagtgagactgtctctcaaaataataataatcatcatcatcatcttgagacctatgttaatcacagaaaagccctaacaaattctgtcatctctgctagtgagttcatgctattgatttgcttccaatgatctgttctacagtttctctatgaattttgtttggatattgctggatattgctggagaaatatgagttctcgtcttcctcttttacaattctatgaggattatttttatatttcttacatttatcactttgaaattatttattttcattccagtggaatttacatacattatactttccaaactgttgatttttgtctttctgtccgtctgccatttatcattgattctcagtgtaggctggccacttcctgcctcaatatgggaatgcctatatctgtgcctgtgtccaggccatatgtataggatggtgttagttctggaaaagacttccgtgcacagttcttcctactcatgtcctcagacctgggagctcagccctctgtgggcctccttcatctcccttctccttctgagtgtacttctggttcttttagactatagtttttgtgctctgattactgtgaatggaagaggacccagaatgccattttaggttgttttataggacacagcaggaagattcactaataggtttttaggtcctttttgggaaaagcaccagaacaaagacaaacctcattttgccaccattgtgtaggacttttaggttttagaacaagtgaaacaatgaggatataatttgagacaatcatttcttttgactgaatgtttgttgtcttctttttctaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430906 - DNA, 1168 bp, Homo sapiens
tgtaagaagcttaatgaatacatataatcttgatggctgggcacggtaatcccagccctttgggatgccaaggtgggcggatcacttgaggctgagagtttgagacctgcctggccaacatggtgaaacctgtctctactaaaaatacaaaaattaactgggcatggtggtgcatgtcagtaatccctgctactcaggaggtggaggcacgagaatcacttgaacccaggaggtggaggttgcagtgagctaagattgtgccactgcactccaatctgggtgacagtgagactgtctctcaaaataataataatcatcatcatcatcttgagacctatgttaatcacagaaaagccctaacaaattctgtcatctctgctagtgagttcatgctattgatttgcttccaatgatctgttctacagtttctctatgaattttgtttggatattgctggatattgctggagaaatatgagttctcgtcttcctcttttacaattctatgaggattatttttatatttcttacatttatcactttgaaattatttattttcattccagtggaatttacatacattatactttccaaactgttgatttttgtctttctgtccgtctgccatttatcattgattctcagtgtaggctggccacttcctgcctcaatatgggaatgcctatatctgtgcctgtgtccaggccatatgtataggatggtgttagttctggaaaagacttccgtgcacagttcttcctactcatgtcctcagacctgggagctcagccctctgtgggcctccttcatctcccttctccttctgagtgtacttctggttcttttagactatagtttttgtgctctgattactgtgaatggaagaggacccagaatgccattttaggttgttttataggacacagcaggaagattcactaataggtttttaggtcctttttgggaaaagcaccagaacaaagacaaacctcattttgccaccattgtgtaggacttttaggttttagaacaagtgaaacaatgaggatataatttgagacaatcatttcttttgactgaatgtttgttgtcttctttttctaggattttcattggctgacccgctctaatatgtaaataaagacgccagttggtggtcttgagttttc

SEQ ID NO: 430907 - DNA, 1989 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430908 - DNA, 1911 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430909 - DNA, 1941 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaagataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430910 - DNA, 1894 bp, Homo sapiens
cttggagacgagtagaaatgggcgatgggggtcggggggttttccttttagcgcccgggagggagggaaggatgtggcgatatggtggggccttgggagtttactcccctgttcttcgttcctcaggatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430911 - DNA, 1894 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430912 - DNA, 1816 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430913 - DNA, 1743 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430914 - DNA, 1087 bp, Homo sapiens
tcatcgagctcgccctgatctgtgtggtgcagccagatccaggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430915 - DNA, 2161 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccagggaaggcttctcggaggtgattcttaaacggagatcagaaggataagcagagactaactcggcaaaggggagagggaagagatgtgcaacaggctctgtagcaagaggaaagaggaagcatggcaagtctgaggaagagggagatgcaactgtaatacaaggatttgtgcaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430916 - DNA, 2390 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggaattgcctccccattgcacagtcaagttagactcaagaagtcagacctggtttcacctcagccccagctttgcttgtgctgtttctgctgtgatgctctgtacacacccacccatttttgccgtgtggagttggctatatgcttcaaggcccagctcaacagtccactcttccatgaagccttcctttctctgaatgttcctgccgcacctggggtgcacccctgtcacaaactcagtgttcacggtgagctaaattcccatctccctcaccatcttgttttgggaaggaagtaatccaggaagggtttatatcacaaaagctatagcagacaattttaaacaaggatgcagggtgaatggatgaactaccaaggatcagaggtccaccctgatgcctgggtattaagtaagcccagcggttcttagagcaatgctggggatggggggctggtgatcgtgaggccctaaaatgactgaagttttatttccaccctggcaaaatgaaggtcaaaattaaaattagatagaattactgaaaataaat

SEQ ID NO: 430917 - DNA, 2081 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaactgctggcccttgcttgtgattggtggttcctctgaaagaaaccaagaaacaatgggagctttccaggagtttcctcaggttgaagcttgtagattatataccaagttctctgcccgcccaagcagcatagaagctattccttttgttattgaaaaggcagtgagaagcagtatctatggtcgtccaggtgcttgctatgttgacataccagcagattttgtgaaccttcaggtgaatgtgaattctataaagtacatggaacgctgcatgtcacctcctattagcatggcagaaacctctgctgtgtgcacggcggcttctgttattaggaatgccaaacaaccccttcttatcatcgggaaaggtgctgcttacgctcatgcagaagagagtatcaagaaattggtggagcaatataaactgccatttttgcccacccctatggggaagggtgttgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccagggaaggcttctcggaggtgattcttaaacggagatcagaaggataagcagagactaactcggcaaaggggagagggaagagatgtgcaacaggctctgtagcaagaggaaagaggaagcatggcaagtctgaggaagagggagatgcaactgtaatacaaggatttgtgcaggattttcattggctgacccgctctaatatgtaaataaagacgccagttggtggtcttgagttttc

SEQ ID NO: 430918 - DNA, 805 bp, Homo sapiens
tgagtgtttgcgaaaagcgtagtatttatgcaaaaaaacaggaaaccttcagaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430919 - DNA, 515 bp, Homo sapiens
  misc_feature (17)..(17): n is a, c, g, or t
  misc_feature (19)..(19): n is a, c, g, or t
cccgcaacccccccccncncaccagcccccccaccccacccctcaccataaaaatctcaggccacttgccaaattgtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacattt

SEQ ID NO: 430920 - DNA, 827 bp, Homo sapiens
tgtttaaggcagttgggttgccctcctgtccgtcagaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggcttgttatgctgcctccgcgattggatatctgacaagcaggtaaactaaaatttgtttcacttcaattactttaatattttggggtagaactattacgtctttcagctgaaggatgagttcatttggaaagattatagaaaaatatattaaataacaaaggataaaaaacatttaaaactctctgaggaccacatcaaaagaataatgataccagaagtgtttcagagtggaacacattgccattttgtagagtgaatcactggtgatcagatagtgagttgatgtatgataccttgtcttggatctcacaactaccccagcacacttaatacaaaaatgcttggttcaaaatgtgactgttgagagctgttccacacgttctgattttttagtgtgtatccatgttacctaactaccaccccctttttattattaaaaattaatacatttttaaaatgtccattttggaaaacttggaaaatatagaaagcacaaagaa

SEQ ID NO: 430921 - DNA, 302 bp, Homo sapiens
catcataattatttttttctccacaaggatgtccagaaaaatgaaaagtgttcattttccagttttaaattatctttgagtagaatatgataagactgagattttacaaatcttttcttctacttgtaatgaacgtaggcagtgagaagcagtatctatggtcgtccaggtgcttgctatgttgacataccagcagattttgtgaaccttcaggtgaatgtgaattctataaagtgagtaatagttatgctggaattctttcttcaatgtacatgtattatcataatgcctacctttttaga

SEQ ID NO: 430922 - DNA, 339 bp, Homo sapiens
cctctatgacatgccccagagggtttcattttaactttgttctccaacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtaaaacatcatcctgaatcagagcatttgattctctagaatatgaaaaatgacacacaagacccagtcacctgacaaatacttatgaagcgttcaccaggtgccctgtgcacagcactgtgttctgtcc

SEQ ID NO: 430923 - DNA, 3561 bp, Homo sapiens
cagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgattttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaaagaatcttaacagttgaattatggagggaaattcccttttgccccaagcgtttctatatttaaagcaatatccccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgcataaagtatatatgagccataaatgaattttgtgtttagactttgtgtccatccccaagatctctcattttatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttggggagatgagggcatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcaccgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgta

SEQ ID NO: 430924 - DNA, 4635 bp, Homo sapiens
cagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgattttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaaagaatcttaacagttgaattatggagggaaattcccttttgccccaagcgtttctatatttaaagcaatatccccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgcataaagtatatatgagccataaatgaattttgtgtttagactttgtgtccatccccaagatctctcattttatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttggggagatgagggcatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcaccgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgtaacaaaaaagaaaaaaaaaacaaaaaaaaatgccttttctcagggccagtgagttgcaaataatttttaaagaaaagcctataattacatcatctcaataaattttttataaaaaaaaaaaaaaaaaaaaaaaaaaaaaaaaaaaaaaaaagagaagaaaaaacaaaaaaaaataacaacacgaaagaggagaaccaaacagatatatagaagagaaacaacagaagatagttgatgtcaaaccaagggggctccctaaaaatagcagacgtgacatctaattaacaggccgccaacggcggcccgcttatatcaacaaacgcaggagaagaggcgaaacaacgtgcagtacgaggggaacgacgaggatgaaggagaacccccacacacgtggaggcgcggcaacaaccaataggaggaacacaataaagcatgcggagcatacacgaccctccgagggggacacaaagatcgaagcagcacgcacaacaaggaggttaaaaacggggcgaactcaaaccacagcacggaaaaaaagaccagacgccacaaagcatgcagcaacagaggaataagatacaagaaaacaataaacaccagggatactaggacaaaacgaagaaacgagacacagaacaaagcaacaaaaagagcaggaaagaaccagagaaagcggcaaaaacaagaaaagagaaagcaaaagaaaaaaagcaaaacgagcaccaagaaacagactacgacgagcggagagaaaagggggaaagcgaaggagaaaacgaagacacagcaaaggaaagcacaagaagaggagagacagagaaacgagagaaggaagaaaggcagacggaccacaacaagacacccagcaagaagaagaggcaaacacaagagagaggacagaggcagacagacaacacaacaaggagaggggggagaagggccgaaaaacgagggaagacgagcagaaacgaaacgaaacaaagacaaggagtcagaaaaaggaaacgaacaggcgagaggaggaaaacagggaaagaaacgcagaaaagagaaagaagagcgggacaatagtagg

SEQ ID NO: 430925 - DNA, 2039 bp, Homo sapiens
cagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgattttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaaagaatcttaacagttgaattatggagggaaattcccttttgccccaagcgtttctatatttaaagcaatatccccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgcataaagtatatatgagccataaatga

SEQ ID NO: 430926 - DNA, 5394 bp, Homo sapiens
agcggggagctgcacgcgggctgccggggcgacgctgctctgcctgcatcccggaggcggccgccagcggatttgccacccagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtccgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaa

SEQ ID NO: 430927 - DNA, 5567 bp, Homo sapiens
  misc_feature (89)..(89): n is a, c, g, or t
agcgggctgctctgcctgcatccggaggcggccgcagcgatttgccacccaggtcctaagactctcagtccagagagggccctgcccancacccagaaggaaggaatgctgcccagagatgaccagaggaatctagacagggtctcactctgttgcccaggctggagtacagtggtgatctcggtacactgcagcctctgcctcctgagttcaagtgattttcctgcctcagccacctgagtagctgggattacagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtccgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaa

SEQ ID NO: 430928 - DNA, 5450 bp, Homo sapiens
  misc_feature (89)..(89): n is a, c, g, or t
agcgggctgctctgcctgcatccggaggcggccgcagcgatttgccacccaggtcctaagactctcagtccagagagggccctgcccancacccagaaggaaggaatgctgcccagagatgaccagaggaatctagcagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtccgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaa

SEQ ID NO: 430929 - DNA, 4566 bp, Homo sapiens
agcggggagctgcacgcgggctgccggggcgacgctgctctgcctgcatcccggaggcggccgccagcggatttgccacccagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtccgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcata

SEQ ID NO: 430930 - DNA, 3953 bp, Homo sapiens
agcggggagctgcacgcgggctgccggggcgacgctgctctgcctgcatcccggaggcggccgccagcggatttgccacccagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtccgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggtttgtgttgattatttatacttttttcagtttagtcttgtcactattttatcgttcttttctcttttta

SEQ ID NO: 430931 - DNA, 4066 bp, Homo sapiens
agcggggagctgcacgcgggctgccggggcgacgctgctctgcctgcatcccggaggcggccgccagcggatttgccacccagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtccgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatcttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaa

SEQ ID NO: 430932 - DNA, 3850 bp, Homo sapiens
agcggggagctgcacgcgggctgccggggcgacgctgctctgcctgcatcccggaggcggccgccagcggatttgccacccagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtccgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatctccaaatatatataccactgtgtattaatctttctctcagtgttttataggagtactaacatttattgctctgtcaataatgaaaggctcgatgtaatatagctgtaatttactttccatatgaatacagtggctaggttcata

SEQ ID NO: 430933 - DNA, 1732 bp, Homo sapiens
atttaatgaatgaaaaaattcacgtctctctttgatcctagactgcaagttacttaaaagaaatggaccgtattttacttatctctcatggcctgcaaattgagtttgcttactgaattaatgaatgaatgaccaattgtacacatatgtctgtaaaacgtttacatatccacattcccattagactgagattcttgagggcagaaaccatgtcttcagctctcagcatggtgcctgactcatggtaggttgtcaaaagcatttgcagaactgaataaaacttacgtttaagtagtactggagcagtctcacataaccgggcacagtgtcttctaaatagacactaaaattatttcataattaaagacagatctcactaagcattttctgagttagtgccagttgaataatatgacaataagctataggagttcagaggagagtgagttctgtggactgaaatagtcaaagtggattttcagagcagatgagacgcgatgaaggctggggctactttggtgttttaagaacattaattaggcagcaggaaaatctgaggacagggagactagtaaggaaggctggaaagagccctgggtttggagttcagagatctgtgttcagagtcctttgcttcttagtgactatgtgaccttgagaagataacttgagctccctttttcctcttctgtgaggtagaggtaagattgatgtgcatattgatattgtacttaaaagtgtttgtaaaatgctaagtaaaacctaatgctatgctttgaatgtagtgggttccaaatatttgtttaatgacaaagaataaatgatattgactaatgaaaataatggagccactggaatgtcacctcctgcatctgccagtaaacctgttaacacaggggtggcgggggggggggggaagtaaatatgtgaagccaccaaatctcatgatcaggagaaaaactttggaactcccatgagactccaaagttatgtcacaggtgaataagtcatgaacttttcatgctgatatcatttctaaggttgctgccttgtcagaagaagcaaaccacaagataaaccatgcagaaaatctttttttaaaaaagtttcctgaaggatggatggttcatttgttctgcttgtcactttacttactaatgagtcatttttttccttaaccagtaatttgttttaaatttggtcataagatggtatgttgactagtccaatgttacaaaataattggaaaaaagatgacagaccaccaactgaataagggaaatctggttcttgaacttccaatgtatgaattggtgatggtaagcttagtctttatgatgtaagattggatttattggaacttctttatgtccagaagttgcagcacctttctttgtctctggaatgcccaagatctctactgcatcctgtagacatggagggtttccccccttattctgggtctgattatttttaaagaaacaccctttccttacccatcatggagacactactaaccttgtatatacttttattagagtgctgataacaccatattacagtagcatacttacatatctgttttcttaactgtgagctccttgagagcagggactgtgtgtttttgcttttatttcaccagtactcagaactatccacagtatagaaaagcactcaataaatggaataaatgaaaatgaatagataaataaatgatttcacttgtataaga

SEQ ID NO: 430934 - DNA, 5596 bp, Homo sapiens
gagcctggggaggtcgagggtgcagcgagccgtgatcgtgctactgcactccagcctgggcaacacagagagaccctgtctcaaaacaaacaaacaaacaaacaaacaaacaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaaaagggagtcggggtggagctctcattggctcgttgcatgtgagtgtccctacggcctagaaataccagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430935 - DNA, 2967 bp, Homo sapiens
gagcctggggaggtcgagggtgcagcgagccgtgatcgtgctactgcactccagcctgggcaacacagagagaccctgtctcaaaacaaacaaacaaacaaacaaacaaacaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaaaagggagtcggggtggagctctcattggctcgttgcatgtgagtgtccctacggcctagaaataccagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaagacctagaaaataagtccccttcctgcctgttgcaaagtaacgtaagagttccctcacccgagtggatgcagaccttcttgctgtcagccacccttccttcatacacatagccagcccagggtgaccagaacctcccaggacagatgaggctttgtgtccttatgagactgggagaacctgctgggcacccctgctgcaggtgctgtggtgggtggggaccccactgcccttcccactgagcacatcgtggctacctgacttggtgggagctccaggcagtcacttctgtttcttaaacatagctttactgaggtacaattcacataccatgtaattcacccacgggaagtgtatgattcagtggtttctaatacagacttctgcagccattaccaccatcaactttacgacattttcatcagcccaagaagacaccctacactccttagctgtccccatccaactcccccaccccagtaaccactcagaataggtatggatttgcctattctggacgtttcgtataaatggcgtcatacactacgtgg

SEQ ID NO: 430936 - DNA, 308 bp, Homo sapiens
gcggccgctactactactaaattcgcggcgcacgactcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430937 - DNA, 551 bp, Homo sapiens
ggcggaggagaggagcgcgcggccgcgcagagcaagctgagccgagccgagccgagctgggggcgcagagcgcgggaggcggcggcggcgcggagcccaggtgagctggcggtagccgggcccggggcaagggacgcagccgccgcggccccgggcgcccgctccgtttccctctcgaggcgggggaccgccgccggcatggcacacaaagcccggaggctggcctggggctcccaacacggagggaccccacgtgcgcctccccacgccccgccacgtggagggacacggtccccgacagcccttcccccgcgtcctctgggcgccctgggcctcgggatggcctcctcggctgggccgcgccctgtccgggtggcaggggcggtcctggagtttggaaccggggtcaccgggggccgggtccgtcagggttcgtggaggcggcctaggcccagcccctcgcgtttgacaggtggggaaatctggagcgttccggggaagagaggaccagcggacttggagcacccccaccccgcagcctgcctgtctcg

SEQ ID NO: 430938 - DNA, 4605 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430939 - DNA, 4889 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430940 - DNA, 4760 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430941 - DNA, 4835 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcgcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430942 - DNA, 4086 bp, Homo sapiens
gtcacgaacttcggctaggtacgaggctgggtgttatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430943 - DNA, 4230 bp, Homo sapiens
ggcggaggagaggagcgcgcggccgcgcagagcaagctgagccgagccgagccgagctgggggcgcagagcgcgggaggcggcggcggcgcggagcccaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430944 - DNA, 4949 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtttccatagcagcatgtctgcaacccagacgcggtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcaggggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430945 - DNA, 4814 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagaca

SEQ ID NO: 430946 - DNA, 4349 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430947 - DNA, 4501 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430948 - DNA, 4104 bp, Homo sapiens
taacgtctagttacagcgcccccctccccagggaccttacccacattctccatcagaaacatagcaagccagacatcacgcttcctttcccttgtgtaaggacagtctccctcctggacaggagacacggattgttgtgggggaaggacagacagtaacccatgtggcatgcccagtgacctccctaagaacaggggagctgtgtgatggtggtgaggggataggctcggggattcccctcgcacctgtcacgccatccacgctgtcacaccggcggctccagcctgggctcttcagggaaacaagggctctcctcctcccacttccaagagggaaggggcctcctcttctgtctgaggtgctcctccctcagggctggctgcaggagggctgaggcgggaggatccctggagcagttgtcatctgccctttcttgagggccagctgtgtgccaggccaggcaggggaggctctgatcacccccacacacaaggaactcaacatctggtgactgaggacaagcgtcacagtcccttccctgtaagggctcatagcctaagtgggggatcgaagtacctaaaaacctggtatgacaggcgccgtggggtggggggtgccttctacttgggatttgtgcagtgaattttggtgttacatagttttggaactgttgtacgggtccttgctatttttggcaaatgatgctggtctttcatttacagaggggctgcgtgcaaagtctcctttgaaaaatttatgtgagcaaggaaaaggggagaggatctcaaagactgggttacgtagatcacgttccagggggtgcgcgacggcccacttgggcagggggcccagatgtgggagcagctggctcagggcctcgctggcatttctcagagtcttaatgttggttttctgttcggtgagcaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430949 - DNA, 4068 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430950 - DNA, 3987 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430951 - DNA, 2791 bp, Homo sapiens
gagtgttggcctgcgtgtctagaggtccccagactcaccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430952 - DNA, 4100 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggtataaaaaaataaatccttgctctcatcttcttcatctccataccttcgacgtctctgaaaatcgtcccattatgtgctcaccctcttgctggtttccctctcgtctctcttcta

SEQ ID NO: 430953 - DNA, 4060 bp, Homo sapiens
  misc_feature (3997)..(3997): n is a, c, g, or t
  misc_feature (4014)..(4014): n is a, c, g, or t
  misc_feature (4022)..(4022): n is a, c, g, or t
  misc_feature (4050)..(4050): n is a, c, g, or t
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggtaaaaaaaaaanaaaaaaaaaaaaaaaanaaaaaaanaaaaaaaaaaaaaaaaaaaaaaaaaaanaaaaaaaaaa

SEQ ID NO: 430954 - DNA, 638 bp, Homo sapiens
catgtggctcggctctaccttgtctctcggtctaccttgttctcggtctaccttgttctctcggctctagcttgtctctcggctctaccttgtctctcggttctaccttgtctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggta

SEQ ID NO: 430955 - DNA, 1927 bp, Homo sapiens
ggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgactcctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaagacttctgcagccattaccaccatcaactttacgacattttcatcagcccaagaagacaccctacactccttagctgtccccatccaactcccccaccccagtaaccactcagaataggtatggatttgcctattctggacgtttcgtataaatggcgtcatacactacgtgg

SEQ ID NO: 430956 - DNA, 412 bp, Homo sapiens
cggagccgttgccgtcggaggatgagaactgcacgctggtcgaagtgactgaagaggaggtcgagaactcagtcaaacacattcccagcttggcaaccgtggtaaggtggatggacccctgacccagagcagggacccaggagcctgaggtggggcctggccaggacaggccggacacaggcgggtgcccgggagtcagatgtccgggggccacccctaatccacagctgctggcctctgggccttggtcatgtatcaggccaggtgacccctgcatcttctgagccaggttccatgttaccataggaaggggaagattatccttctggaattcctgctttcagagctcatcaggggagaggaactaggagaagttccaggcaggggcaagggttgggagccggagcccagg

SEQ ID NO: 430957 - DNA, 222 bp, Homo sapiens
gatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggtaccaagcctgggcctcttggg

SEQ ID NO: 430958 - DNA, 137 bp, Homo sapiens
caaagggtactttataaagaatgtgaaaattgctgtttcttaagtaaatatttctgagattaaatgtttttttaacaaatattttggtgagtctttaaaattctcacattcattaaaatctttatctaaaactgcac

SEQ ID NO: 430959 - DNA, 2595 bp, Homo sapiens
actccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaaaaaaaaaaac

SEQ ID NO: 430960 - DNA, 504 bp, Homo sapiens
tggagatttggtgcttctagaaacaatgcctttgtgagctaaacgaaccagagggagcttcttgtgacatcctgaggccaggcgtttagggaagaaggaagagagtgagcccccaggccggtagtcttccaaagaaggagcattctgatggagaggtctctgctatcttccctaagaaatctcgggtagaagttagccattagaggccaggcatggtggctcacgcctgtcatgccagcactttgggggaccgaggtgggcagatcaccctgaggtcaggagttcgagaccagcctggcccacatggtgaaacccctctctactaaaaatacaaaaaattagctgggcgcggtggcgggcgcctgtaatcccagccacttgggaggctgaagcaggagaatcgcttgaactcgggaggcggaggttgcagcgagccgagattgcgctactgcacttcagcttgggcgacagcaagactccgtctcaaaacaaagaaaaaagatt

SEQ ID NO: 430961 - DNA, 2515 bp, Homo sapiens
actccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttccaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaaaaaaaaaaac

SEQ ID NO: 430962 - DNA, 1897 bp, Homo sapiens
tgtcctcaccctgcctacagtgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaaaaaaaaaaac

SEQ ID NO: 430963 - DNA, 1940 bp, Homo sapiens
tttctcagccccatttgtgcaacctctgatcaagccatcctggcaacgcagggcaggctcacagtgccaacacatatagcaagccaccccccagggccactctggagtttccctgaaagcagaagactccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaaaaaaaaaaac

SEQ ID NO: 430964 - DNA, 2259 bp, Homo sapiens
actccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgtggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaaaaaaaaaaac

SEQ ID NO: 430965 - DNA, 980 bp, Homo sapiens
ctggccccagggtccgctctaaccggtctctgttgcggctcagtggaagacctggagcggaacaacggctccctggaccggccctactacatgtccaagagccattagagagacttcccagcaggtggctgtagcggcaggggattttcttactctacagcatgcatccattcagggtttgccagtctcctcctaagcgactgacatgcattttttccgctaattcttatcatcgctctatgcaacataatattcccgaccccacttcacaggaggaaactgagattacataacctgcccgggggtaagggtggtggtgcagcttggattccaaatcccgcaggcagcttgcctcccagtccccgatttcctggccccagggtccgctctaaccggtctctgttgcggctcagtggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaaaaaaaaaaac

SEQ ID NO: 430966 - DNA, 710 bp, Homo sapiens
actccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaagtgagtacaaaggcgagaagaggagtgcaggagcgaggcgaggtagggtgggcaggagacacccccccaactcaggctccagacctgtccgtgctcttccacagcctttccctgctgtccccaccccacctcagcctccctgaatctgacaactccaggccacgttaagaaccattgctggacagttagcttcttgagtccccccagaaatgggaggcagtggagagtcgtgttaagtgtatgagttttacagttcagagattggtgtttggatccccaactggaccaagttttggttgtgtggccttggacaagttactcaagctctctgagctttgatttccttatttgagattcaaggggaattccagaagcaatgccaacagtcctcacatacagatgtccaataaataataaaacctcaaatatttatatagcatttactatgttc

SEQ ID NO: 430967 - DNA, 663 bp, Homo sapiens
actccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaaaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaaaaaaaaaaac

SEQ ID NO: 430968 - DNA, 264 bp, Homo sapiens
ctccccagttttcccctcctgccagtcctgccctagcccatctccctccaaacacctgaggcctgggtaggatcctggggctaggaggactcagcaggacaagatatgcagagagagactcatcctccacacctcttctcatgtccctcagggaagccagtcaaatacgacccctcctttcgaggccccatcaagaacaggtgagctctgggcactgctccgggggctggcgggggtggtgggtgcagtgtggaatccagtatt

SEQ ID NO: 430969 - DNA, 446 bp, Homo sapiens
tctcaaaacaaagaaaaaagattaaaaaaaaaaaagagccattagagagacttcccagcaggtggctgtagcggcaggggattttcttactctacagcatgcatccattcagggtttgccagtctcctcctaagcgactgacatgcattttttccgctaattcttatcatcgctctatgcaacataatattcccgaccccacttcacaggaggaaactgagattacataacctgcccgggggtaagggtggtggtgcagcttggattccaaatcccgcaggcagcttgcctcccagtccccgatttcctggccccagggtccgctctaaccggtctctgttgcggctcagtggaagacctggagcggaacaacggctccctggaccggccctactacatgtccaagagccttctaaagattctgggcaagaagaacgaggcgcccc

SEQ ID NO: 430970 - DNA, 1735 bp, Homo sapiens
actccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccgtcacgagggtacacgagctcgatca

SEQ ID NO: 430971 - DNA, 998 bp, Homo sapiens
actccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagccagctgcagcacttgaaacagcacatgatgtc

SEQ ID NO: 430972 - DNA, 130 bp, Homo sapiens
gattacaggcgtgagccaccgcgcccggccggggtcagccccttgagaagatggacagctggggcggtgccggttaacagctttgtctccctgcagggctgtgggacagatgatgtctaccatgttctac

SEQ ID NO: 430973 - DNA, 3805 bp, Homo sapiens
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcc

SEQ ID NO: 430974 - DNA, 1367 bp, Homo sapiens
gagacagtgggagggtcacggtcaccgtaaccaagaaggctgctcttacggccgccagatgcggtgcccagcataacaaccgctggctgtgaagttgttgggaattcacccacctccccgagtcaccctcgggccccgggtgcgcctcagatgttggccagaaactgtcctttgtgggactcagcgcaccgtgcacactgggcccttcataatcccggggcctgcaggcggtctgggcggtcctgctgctgccagagtgactgcgccagggccctgcctgaccctcgccctgaccgcgccctgcaggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgtaacagcttgcgaggacgggtgcggtccttctgggaaccagtacatgacctggaaggatcttactatgcttaccatgaatcatccacggatcaacctagcaagtaaggactagagccatttaccacgaggaacatagtgggaacatggttcaagacccaagcgacctccatccaactttcggaacaggttagacctcgcgaaaaaaatgggctaacaaggagactccaggaggaacagccgggagaacagacggacaagtggaagagtgataacgagcgagggaacacgtagagagacgggtatacgcgagccatgagcaacgaacaggcaacgtccacgaggatagaagcgaggaaaaatacacgggacactaacgagcagagtatagtacggaccacagagagcgacgtcagaaggcacaaaacagagcaccacgacagacaacacacaacagaagagaagcgaaacgaagagagacagaaga

SEQ ID NO: 430975 - DNA, 4212 bp, Homo sapiens
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcccgcctttgccagcgtcgtccctcccaccccacccagaccacgtccaacagcctgggactttcgggaccctggggtcggggcaccgtgtggagtgagacaggcgtgaaagacagcggctgcggccacccagggcaccagccacatcctcttcctcgtccccgcccctcagcctccctcctctggctcctggctggtgggtctgggggcaaggcagaggcgctccaggtggaggggggcgggccggggtgcccacgctggggtgacgcaagaagaaaactcccgggcctcagagtcggcgccggaaacctaggtctgggtttccctcgtggtggttgtgtactgaggacctggaagtgatcatattttggatatattcggttaaataaaatcagcggttaggattcaca

SEQ ID NO: 430976 - DNA, 3989 bp, Homo sapiens
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagccaaaaaaaaaacaaaacagacctcggaggcacacaaatacaggactgccgcaaaacgagggtaacgaaagtgccacatggccatagcgcgtgatcctagacccagtttcatgaccacagggtgtagacttgcgggaccccaaagagagcagattaatccaaagccggtacctgtataacatgaag

SEQ ID NO: 430977 - DNA, 4421 bp, Homo sapiens
  misc_feature (4337)..(4337): n is a, c, g, or t
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagccaaaaaaaaaaaaaaaaaaaaaaaaaaaaaaaaaaagggggggcgggttctagtggtatcctgtggagggcccatgtgtgatatgggtgcctcttgttgtctgtggccgcggtggtgcccatatatagtgtacgtcgtgataatatcacgtcattgcgcgatgacgtggcgtgtatgaaccactgcggcgtgacgacatgtgtgcaacatggtgtcgtactgtgtgtgcgatagtatttttgatgtgtacacgggacactgctataaattacttgggtgtgtgtgttgcgtaataatttgtggggtgatgtttatatcttgtgtggtgatgtgttttgtgtgtgtgtgtgtgcatgatgtgtgtatgtatgtagtgtttgcgtcgttttgtatgttgctgtagtgtgttgttgtagtgttgttgtgttgtgctgcctgcttcggtgtttggtgatgtcttgttgtgatggcctgtgttgctgtgttcgtggtggttcgctgtgtgtttggcggtagctgtgtgactgtgggtngtgttgtgttggtgatctattgatagatgagtactatagtaaatacatacaacctcgaaataaatcccacttaaaatgatagcc

SEQ ID NO: 430978 - DNA, 3574 bp, Homo sapiens
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaaggccccaaggtgtccgagtgtgttgggtctgaacgcgaaataaagaaatcctctcagcc

SEQ ID NO: 430979 - DNA, 2221 bp, Homo sapiens
gtacgcggccacgaggtttgttcctggctgtggggctgctgggcctgggcagggcctcctccgtctgtgtatcttggtgggtttgggcctgccaccacactgacacctcctccgtgtcacctcccacagatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcc

SEQ ID NO: 430980 - DNA, 2107 bp, Homo sapiens
acgctagaaaagccgggttaacgacaggacggaccaatgcccttaatggaactgctgcccagactgagcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcc

SEQ ID NO: 430981 - DNA, 1313 bp, Homo sapiens
aaggagcctggttgtaccagagtgagagtcataaactgaccatagtgtgtagcggaactgtgaggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcc

SEQ ID NO: 430982 - DNA, 2173 bp, Homo sapiens
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagctgccggcagcccccgcaagacgggcagcccccgcaagacgtcatctgaggctgtgagtcttgcctggacaggcttttggggacaggaggcccaaggagcagtagagggcaatcgttaagattgtggatagactgtagggtactggtgaaggattcaggatttggccgggcacagtggctcacgcctgtgatccacacacttcgggagaccgaggcaggtagatcacaaggtcaggagatcgagaccatccaggcaaacacggtgaaatactaaaaaata

SEQ ID NO: 430983 - DNA, 1638 bp, Homo sapiens
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcagtatccttcccagtgcggccgctgcagcttgggagggggtcgtggcctgggccgagtcccgggcagaagtcctgagcccagcgtgttccagtgcaggtggaggcggcccggccaggctggctgtgtccctgtcatggttgggccgtgagacgtctctgggatgtccagtgaacatcatggctccacccagcagggtggcatctgccaggctggtctgtggggcagggctgaggtctgggctgggtggtcctgacggggaagcagccagccctccttgatgagccccagatatcgacaagttcacagagaagggcggactgtccttctccctgttgctgtgggccacgctgaacgccgccttcgtgctcgtgggctctgtgattgtggctttcatagaggtgggtggcaggatgccgcagctatggcggaccccatgaaggattgggggtcttggtgaatgggcgggaacccctgcagctcacccacccccaccatcacattggctgacaacccgggcacttttagaatcacgtggtccagactcacaacctcaggaggagcagacacaccagggcctcttcacccccagagccctggggtgctgctcctgacctaccagcacaggcctgggcaccctcaccccactccgcccctccttccatctcctcactctgccctcccctccttccatctccacctccgcctccaccacgtccttgatctgtgtctgggctgggaagagtgagagcagctaccccaacgacatgagacccttccctggggccccaacgtgtgtgctgctcttcccttccctgaggccccgacatgtgtgctgagctccccttccctgaggccccgacgtgtgtgccgctctccccttccctggggccccgaagtgtgtgctgagctccccttccctggggccccgaagtgtgtgctgagctccccttccctgaggccccgacatgtgtgctgctctccccttccctggggccccgaagtgtgtgctgagctccccttccctgaggccccgacatgtgtgctgctctccccttccc

SEQ ID NO: 430984 - DNA, 159 bp, Homo sapiens
ctccaggcagccccgcgtttcctgtccagcggcttcacacctcaccagcccgcagaggtaactgtgggagttggtggcgtgtgacgggcatgtgtggccgggctcctccggcagggaggtgatgagcacaccagtgacctgcctgaggcggcgtgagaa

SEQ ID NO: 430985 - DNA, 398 bp, Homo sapiens
ttttagcctttctgcttcccagggaggctgagaacagggagccttctggggaccgctgggctcgggagctcaggttgctgggctcctggaaggtgactgtgaggcccgagactgggtagtggggcagggcagtcctgcggaggcgggagtcgtggaggccccgtcagcccctcttctctcctaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcggtgagtggggccggaggggaggctgtggggccctgcagctgagc

SEQ ID NO: 430986 - DNA, 4093 bp, Homo sapiens
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcagtatccttcccagtgcggccgctgcagcttgggagggggtcgtggcctgggccgagtcccgggcagaagtcctgagcccagcgtgttccagtgcaggtggaggcggcccggccaggctggctgtgtccctgtcatggttgggccgtgagacgtctctgggatgtccagtgaacatcatggctccacccagcagggtggcatctgccaggctggtctgtggggcagggctgaggtctgggctgggtggtcctgacggggaagcagccagccctccttgatgagccccagatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcc

SEQ ID NO: 430987 - DNA, 3664 bp, Homo sapiens
gagacagtgggagggtcacggtcaccgtaaccaagaaggctgctcttacggccgccagatgcggtgcccagcataacaaccgctggctgtgaagttgttgggaattcacccacctccccgagtcaccctcgggccccgggtgcgcctcagatgttggccagaaactgtcctttgtgggactcagcgcaccgtgcacactgggcccttcataatcccggggcctgcaggcggtctgggcggtcctgctgctgccagagtgactgcgccagggccctgcctgaccctcgccctgaccgcgccctgcaggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcc

SEQ ID NO: 430988 - DNA, 2704 bp, Homo sapiens
gtgccgagcgggctctcccagaaggggacacagatccccgaccatttccggccacctttgaggaaaccagggaagtggtgtgccatgcacgtgaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcc

SEQ ID NO: 430989 - DNA, 3913 bp, Homo sapiens
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagttgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcccgcctttgccagcgtcgtccctcccaccccacccagaccacgtccaacagcctgggactttcgggaccctggggtcggggcaccgtgtggagtgagacaggcgtgaaagacagcggctgcggccacccagggcaccagccacatcctcttcctcgtccccgcccctcagcctccctcctctggctcctggctggtgggtctgggggcaaggcagaggcgctccaggtggaggggggcgggccggggtgcccacgctggggtgacgcaagaagaaaactcccgggcctcagagtcggcgccggaaacctaggtctgggtttccctcgtggtggttgtgtactgaggacctggaagtgatcatattttggatatattcggttaaataaaatcagcggttaggattcaca

SEQ ID NO: 430990 - DNA, 3076 bp, Homo sapiens
ggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgatcgaggccatgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcagcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagaaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcc

SEQ ID NO: 430991 - DNA, 545 bp, Homo sapiens
  misc_feature (478)..(478): n is a, c, g, or t
acgccgtatagctctgagcttcaccaacctcaagttttcccctttctgtgggttcttcacaagctcctggggcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagttcagcgtctgacgtcagacgctgaactatgtgccagtaatcttcaaaaggcagaacatatcacctctgccccgtaaactgttctctccgagggaaaaaatggaagttatcctcacggttcactgccgtggtatttcttctgtcccatgctttgcatgactgccatggtacagccttgtttcaaactgttcactgtgatctgtgngtctttgagtttcagtgagtttgctgaaatgtcgaagaagtagttccaaacttcaatgttcaatgaa

SEQ ID NO: 430992 - DNA, 3409 bp, Homo sapiens
tgggtttcggggcgagcgttgggcgccgccgcgccgcgctgggtgctcggtccgactcagcggtggggagtgagccaggcctcccgccaccgctgctgccgccaccactgcgtcgggctggtgcagccccgggccaggccgcggccggggcaggagcgcaggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggacaaggatgagggaggttaacagcaggtgctaccaacctgagccttttgcatgtggcattgagcactgttctgtgcactatgtgagtgacagtggggatggagtctatgctgggaggcctctgtcagttatacagatggttggccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccaatttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtaccgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgtttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaaacttaaataaaaacatgcatcttaaatggaaaaaaaaatttgcaaag

SEQ ID NO: 430993 - DNA, 2941 bp, Homo sapiens
gatctatgaaaataaaaagttcctgggatattgatgggagagctactaagagaaggaactttttattttcatagatcctatcctgttactacactggtgggatctatgaaaataaaaagttcctgggatattgatgggagagctactaagagaaggaaaaaatcaggggatcttaaaaaagccaaggtacaggtggacaaggatgagggaggttaacagcaggtgctaccaacctgagccttttgcatgtggcattgagcactgttctgtgcactatgtgagtgacagtggggatggagtctatgctgggaggcctctgtcagttatacagatggttggccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccaatttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtaccgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgtttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaaacttaaataaaaacatgcatcttaaatggaaaaaaaaatttgcaaag

SEQ ID NO: 430994 - DNA, 3143 bp, Homo sapiens
tgggtttcggggcgagcgttgggcgccgccgcgccgcgctgggtgctcggtccgactcagcggtggggagtgagccaggcctcccgccaccgctgctgccgccaccactgcgtcgggctggtgcagccccgggccaggccgcggccggggcaggagcgcaggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggacaaggatgagggaggttaacagcaggtgctaccaacctgagccttttgcatgtggcattgagcactgttctgtgcactatgtgagtgacagtggggatggagtctatgctgggaggcctctgtcagttatacagatggttggccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccaatttaaactcctgtgaagacccagttccagggatgttgttttttttgccacctggtcagcacttgtcagactattcccagttgaatgaaagcacaacaaaagagtcttcagaggccagccagcttgaagatgtgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgtttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaaacttaaataaaaacatgcatcttaaatggaaaaaaaaatttgcaaag
